United States Patent 9,290,773 (TRANSGENIC PLANTS WITH ENHANCED AGRONOMIC TRAITS) - sequence listing, part 6

SEQ ID NO: 23191 - protein, 502 aa, Musa acuminata
AGNDWINSYLEAILDAGPSIDAAKSSLLLRERGRFSPARYFVEEVITGYDETDLYKTWVRAAAMRSPQERNTRLENMCWRIWNLARKKEQIEGEEAQRLSKRRLEREKARRDATADMSEDLSEGEKGEAIGDLSVHGDSTRGRMPRISSVDAIEALTSQFKDKKLYIVLISIHGLIRGEDMELGRDSDTGGQVKYVVELARALGSMPGVYRVDLLTRQISAPDVDWSYGEPTEMLTPRSSDSFMHQMGESSGAYIIRIPFGPRDKYIPNQHLWPHIQEFVDGALGHVLQMSKVLGEQIGSGQPIWPDAIHGHYADAGDSAALSCLALNVPMLFTGHSLGRDKLEQLLKQGRQTREEINATYKIMRRIESETLALDASDIVVTSTSREIEEQWALYDGFDAVLERKLRARIKRGVSCYGRYMPRMVIIPPGMEFNHITIHDGDVDGESEGTDENSAVLDPPIWSEIMRFFTNPRKPMILALSRPDPKKNITHLVKAFGECRPL

SEQ ID NO: 23192 - protein, 360 aa, Leishmania donovani chagasi
MARHRYAHVNVNKPSSYWDYDSLRVQWNSPDRYEVVQKIGRGKYSDVFLGVDTKVPRQVVIKVLKPVKKKKILRELMVLQTLKGGPNIVDLFDVVREPNSKTPSFVFEYVKSCDFRTVFPTFTDLEVRSYIFQVLMALEYAHSHGIMHRDVKPNNVCLDYKTGKLKLIDWGLAEFYHPATSYNARVASRYFKGPELLVELPMYDYRLDMWSLGCMLAAMIFIREPFFRGKDNTDQLVRIVKVLGTDDLQVYLKKHNASLPPVLEATLGYHAKKPWRSFVNGQNEHLCPPEALAFLDKLLQYDHMKRIQAAEAMMDPYFDPVRPKDFTLDGITVAAENGGGGASVCNEENVHEKRVPRIES

SEQ ID NO: 23193 - protein, 193 aa, Griffithsia japonica
LGMVVRKVKGPWRPEEDAILTQLVAKLGPRRWTVIASHIPGRTGKQARERWLNQLSPDLAKRPWTPEEDRVVMQAHARLGNRWSEIAKLLKGRTDNATKNRFNTTIRRQISELAAGNARADSVGGASSVVDSGAPTEMGVASAGEGGGGLVEASVMGLSCDGDDRRNAKRKRDGSHSSHEPMSQRTKTLTAST

SEQ ID NO: 23194 - protein, 205 aa, Griffithsia japonica
MTIVQVQTPFTEMPTLKRVHKWVYSFGEGKADGDKSMRELLGGKGAGLAEMSGLGLPVPPGFTISTSVCTVFSNNAGQYPVGLLSQVKQALSVVEKQMGASFGGKDHPLLVSVRSGSRASMPGMMDTVLNLGLNDQTVKGLATHSGNPRFAYDCYRRFIQMYSNVVLGVDIDHFEEILESHKRKNGVKLDTELTYDNLKEVIIDY

SEQ ID NO: 23195 - protein, 201 aa, Griffithsia japonica
GTRGSNKVSGVNATEVVKPEGGVESSRESRRQQRWLRKGMQQVKARHELVTGSMLQERRKAVFCRRSGIHGFGLYAQEEIEAREFVIEYVGVVIRQSVADVREREYEEGGVGDSYLFRLNGEMVVDATRRGGIARFINHSCDPNLTATTQRVGGTERIVFYSRRHIGKYDELTYDYKFALEGDDKKIRCLCKSLNCRKFLN

SEQ ID NO: 23196 - protein, 774 aa, Misgurnus mizolepis
MQCVRRQHVRTKSQDLLYSAQIEEAARDNMKLLGLEGDTDLQFLLNGGDLLKVRSGSWKKIRYFKLQEDCKTLWHESKKTLKSKQTFSVEDIEAIRTGRQTEGLKKYTGDALEGQAFSILFKGRQKSLDLIANSEDEAKKWINGLEKVISNMNNLSPLKKTEHWIYSCMRKSDKDFDKKMSPKELKSFLQSINIEVDDDYAKILFEKCDTSKSGFIEGKEIERFYKILTHREEIDVIYGEYAKTGSLMSTTDLLNFLLKEQKDSASQTDALQLIDKYELDEDAKAKQLMTKDGFLMYLHQPEGLIFNQAHKSVYQDMNQPLNHYFISSSHNTYLMEDQLKGPSSTEGYIKALVKGCRCVEMDCYDGSDGEPVIYHGNTLTPEIFFKDVIQAVKEYAFKTSAYPVILSLENHCGLEQQKVMAQHMISILGDALVTKPLGDKMPTCFPSPEELKGRFIVKAKSRGKLEDKFSDEEKAEDAGSVTEEEDDEGEEDEEKKTDKSKSMKVAKELSDLVVYCKSVPFHGFEDSREKQSFYEMASFKESKAVKLAEENANEYIRHNTDKLSRIYPSGLRADSSNYDPVPLWNAGCQIVALNFQTPSTEMDLNHGLFLQNGQSGYILKPAYLRDPATEFDPITLTRGPWLNQKNLHVMVISGQQLPKTNEKESSVVDPLVKVQIYGVPADTNEKETAYIANNGFNPMWNENFQFEVCVPDLALVRFLIEDHDSTSGNDFIGQCTIPFNSLKNGYCHVPLFNQNGDLLSSARIFVHIMVVDSE

SEQ ID NO: 23197 - protein, 552 aa, Sus scrofa
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAQMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLVIDNRRIMNQASEFYLASSPPTGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVLEQRSGSSTPQRSCSAAGLHRPRSSLDSVTAESHSLSGSLSGSLTGSMLPSVPPRLGSHTMDFFEMCASLITTLAR

SEQ ID NO: 23198 - protein, 115 aa, Lycopersicon chilense
MAEEKHQHHHHLFHHKNREDEGGPVDYEKEVKHHSHLEKIGELGAVAAGAFALHEKHKAKKDLENAHKHKIEEEIAAVAAVGAGGFAFHEHHQKKDAKKEKKEVEGGHHHHQHHY

SEQ ID NO: 23199 - protein, 114 aa, Lycopersicon hirsutum
MAEEKHQHHHHLFHHKNKEDEGGPVDYEKEVKHHSHLEKIGELGAVAAGAFALHEKHKAKKDPENAHKHKIEEEIAAVAAVGAGGFAFHEHHQKKDAKKEKKEVEGGHHHHHHY

SEQ ID NO: 23200 - protein, 413 aa, Aplysia californica
MNKLLSQFYTVEVGDSTFTILKRYQHLRPIGSGAQGIVCAACDMLTDTNVAIKKLSRPFQNVTHAKRAYREFVLMKLVNHKNIIGLLNAFTPQKSLDTFQDVYLVMELMDANLCQVIQMDLDHERMSYLLYQMLCGIKHLHSAGIIHRDLKPSNIVVKSDCTLKILDFGLARTAGTGFMMTPYVVTRYYRAPEVILGMGYKANVDIWSVGCIMAELIRATVMFPGTDHIDQWNKITEQLGTPSQDFMSRLQTTVRNYVENRPKHTGHSFEKLFPDVLFPPDSTEHQGLRAMVARDLLSKMLVIDPEKRISVDEALMHPYINVWYDEREVNGPAPGPYDHAVDEREHSVLEWKMFIYNEVMEYENREREKEKQSAMQNHNDGANNTMETGGAGAESNSTSRGAAATAATAQNHH

SEQ ID NO: 23201 - protein, 539 aa, Zea mays subsp. mays
MSIGLTAETVTNKLASAEHPQVVPNSVFIALLCLCLVIGHLLEENRWVNESITAILVGAATGTVILLISKGKSSHILVFDEELFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSVVLFNAVQKIDFEHLTGEVALQVFGNFLYLFSTSTVLGIATGLITAFVLKTLYFGRHSTTRELAIMVLMAYLSFMLAELFSLSGIITVFFCGVLMSHVTWHNVTESSRITSRHVFAMLSFIAETFLFLYVGTDALDFTKWKTSSLSFGKSLGVSSVLLGLVLVGRAAFVFPLSFLSNLSKKHPGEKITIRQQVVIWWAGLMRGAVSIALAFNKFTRAGHTQVRGNAIMITSTIIVVLFSTVVFGLLTKPLINLLIPHRNATSMLSDDSSPKSLHSPLLTSQLISSIEEPTQIPRPTNIRGEFMTMTRTVHRYWRKFDDKFMRPMFGGRGFVPFVPGSPTERSSPDLSKA

SEQ ID NO: 23202 - protein, 538 aa, Zea mays subsp. mays
MGYQVVAAQLKLASSADHASVVIITLFVALLCACIVLGHLLEENRWLNESITALIIGLGTGVVILLISRGKNSRLLVFSEDLFFIYLLPPIIFNAGFQVKKKQFFRNFMTITLFGAVGTMISFFTISLGAIATFSRMSIGTLDVGDFLAIGAIFSATDSVCTLQVLHQDETPFLYSLVFGEGVVNDATSVVLFNAVQKIQFTHINAWTALQLIGNFLYLFSTSTLLGIGTGLITAFVLKKLYFGRHSTTRELAIMILMAYLSYMLAELFSLSGLLTVFFCGVLMSHVTWHNVTESSRTTSRHVFATLSFISETFIFLYVGMDALDFEKWKTSSLSFGGTLGVSGVLMGLVMLGRAAFVFPLSFLSNLAKKHQSEKISFRMQVVIWWAGLMRGAVSMALALNKFTRSGHTQLHGNAIMITSTITVVLFSTMVFGMITKPLIRLLLPASGHPRELSEPSSPKSFHSPLLTSQQGSDLESTTNIVRPSSLRGLLTKPTHTVHYYWRKFDDALMRPVFGGRGFVPFVPGSPTERNPPDLSKA

SEQ ID NO: 23203 - protein, 545 aa, Zea mays subsp. mays
MSMGYQVVAAQLKVASSADHASVVIITLFVALLCACIVLGHLLEENRWLNESITALIIGLCTGGVILMTTKGKSSHVLVFSEDLFFIYLLPPIIFIAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNAVQKIQITHINAEVALQVFGNFLYLFSTSTLLGIATGLITSFVLKKLYFARHSTTRELAIMMLMAYLSYMLAELFSLSGILTVFFCGVLMSHVTWHNVTESSRITSRHVFAMLSFIAETFIFLYVGTDALDFDKWKTSSLSFGGTLGVSALIMALVLLGRAAFVFPLSVLTNFSNKHENESITFKHQVIIWWAGLMRGAVSIALAFKQFTYSGVTLDPVNAAMVTNTTIVVLFTTLVFGLLTKPLIRLLMPHRHLTMLSDDSTPKSLHSPLLTSQLGSDLEEPTNIPRPSSIRGEFLTMTRTVHRYWRKFDDAFMRPMFGGRGFVPVVPGSPIERSVPQWSEEAHNKEP

SEQ ID NO: 23204 - protein, 541 aa, Zea mays subsp. mays
MGLGVVAELVRLGVLSSTSDHASVVSINLFVALLCACIVLGHLLEENRWVNESITALIIGLCTGVVILLTTKGKSSHILVFSEDLFFIYLLPPIIFNAGFQVKKKQFFRNFMTITLFGAVGTMISFFTISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 23205 - protein, 218 aa, Pinus taeda
MSASVGGMEKSGTSAQQENNRSLDFAETELKLGLPGVATGERQRICGKRSFSEARESRKFSIPHEEAHKFHEPNLGTEKQMVRPANDPPKMGPPPPRKAQIVGWPPVKDFRKVRTIAASSSLYVKVSMDGAPYLRKVDLKMYSTYHDLSSALENMFGCLITMGKSGSHALNESNLFDVRNGSEYVPTYEDKDGDWMLVGDVPWDMFVDSCQRMRIMKA

SEQ ID NO: 23206 - protein, 302 aa, Pinus taeda
MERFANDGDEHSLKETELRLGLPGVCESDTGLGQTRNGKRAFSEVMDSTKASSFNDNKWIFPSVKCQPPTSAITETAEACKGSQPGLFSATPGQKIMMQGGCGAPQSWAGDNGLSKSTAPKDELHPKTPRGGPTEKTNAASQSQAATDPAMAPAPKAQVVGWPPIRSFRKNTLAANSKPNDEGSSSNALYVKVSMDGAPYLRKVDLKMYSTYHELSSALEKMFSCFTMGQCGSPGLSESKLIDLLNGSEYVPTYEDKDGDWMLVGDVPWEMFVDSCKRLRITKASEAIGLAPRAMEKSRSKN

SEQ ID NO: 23207 - protein, 252 aa, Pinus taeda
MSCSVGNMAMVLEKSGGNAQHEKRDSLDFAETELKLGLPGVAAGARQRICGKRSFSEAMESRNYTIPDEDITNTSTHEDLDKFKGPIVKEKQMALSANDPPRMGPPPPSKAQVVGWPPVRDFRKVRTVAASNSLYVKVSMDGAPYLRKVDLKLYSTYHELTSALEKMFSCLIIMGKCGSLALNESNLMDLPNGSEYVPTYEDKDGDWMLIGDVPWQMFVDSCQRMRIMTASEAIGLAPRTMENCKNRNRVHP

SEQ ID NO: 23208 - protein, 231 aa, Pinus taeda
MSCSVGGMEKSSTGAQQENKCSLDIFAETELRLGLPGVAAGERQRICGKRSFSEAMESRNFSIPQEEAHKFHEPNLGTEKQMVRPANDPPKMGPTPPKAQIVGWPPVKDFRKVRTIAASSSLYVKVSMDGAPYLRKVDLKMYSTYHDLSSALENMFGCLITMGKCGSSGIKESNLMDVVNGSEYVATYEDKDGDWMLVGDVPWQMFVDSCQRVRIMKASEAIGLAPRAMEK

SEQ ID NO: 23209 - protein, 252 aa, Pinus taeda
MSCSVVGSMGMALEKSGGNAQHEKRDSLDFAETELKLGLPGVAADESRAHQKSCGKRSFSEAMESRSYTITDVDITRTGTPEDADKFHGPIVKEKQMALPANDPATTGSRPPPKAQIVGWPPVKDFRKVRTISTCDSLYVKVSMDGAPYLRKVNLKIYSTYHDLSSALENMFSCLLTMGKSRSHGLNESSLMDMPNGSGYVPTYEDKDGDWMLVGDVPWQMFVDSCQRMRIMKASEAIGLAPRTMEKCKKRN

SEQ ID NO: 23210 - protein, 253 aa, Arthrobacter ilicis
MASSVGNDFEGLAALVTGGASGIGAAIADRLAAGGAKVAVLDLAPETSPHFGVQCNVADDASVRTAVERVVQQFGRLDIVINNAGIGAQGDIAANDDDEWLRVLNVNVVGIARVSRAALPHLRESPAAAIVNTCSIAATAGLPQRALYSASKGAVLSLTLAMAADHVREGIRVNCVNPGTVDTPWVGRLLDSAADPAGERAALNARQPHGRMVVPAEVAGAVAYLASPLSGSTTGTSLAVDGGMQGLRLRPVQ

SEQ ID NO: 23211 - protein, 871 aa, Cryptosporidium parvum
MENNNIFPPEITGEQVMTVVCLFGICAPSSAFLESFFGHRTIFNGKVRLPLSVVLFGYGIMMDYVLRTFNFGIFSMAIKHAESMHPNIIFSVLLPICLYESSSQLNYHIFKRNLISSVLLALPGVIVSMILTTFFMYYFVGGIFDWTCSLLISSILSATDPVAVIASLHQLNAPDKLASLVDGESLLNDGAAVVFFQLCKNILLNRFLEPSLILTSGWIFIRCALGGPLLGFLFGWGVHLFLKVAQATNDVQVFIAISIVYTLFFLSELIHSSGVLAVVTYGVFMSSRKAALFKPKAQEIHNTIIHFVGKLGNHMIFMLAGIVSARLFRPYIEDTNMLMNLFLLFAAICVIRGIMVFILSPLLTRIGYGLTIKEAIILIWGGLRGGVSLALAMSLESEDYIDPELKGQIAFYVAGTVLLTLLINGTTVEFIYKKLQLYTTPKFHRMFFKKVMKSINEEYRLVINDQIRKHWFFNAHPGLLELCDTFIPNVIDAKMTETGEIILSSQLSQYTFIKNIKSTNIQLIMQDPTAPIGHDSNKYLNQRTLSCLTRDEEFEDRFIKELDINNTQTESNSFKNSPNNLLNAKPEENQTILLINSVPVSNYKSNNDNSSISTLKRESITSDNSKIKVGRHVYIGQMVLSTVWQSYDLLFKNHVISGAALVVLKKAISKVFYSCEELNLPIHFAFSSEWDSIRSQLWICKENLLTDTKALSLSSELLNEYNQKNISSTFCLPSFINYYRNKVKSKNLFLDIEVLFSFITARVDLLEHDFQELQSYLGPSSIQLFQNQIIEAQQYLELLLSYSQEQYSIAISHISVNILFNALRDSMKVLVKSRLLLEEDEEKLLALCEDRRFIFSSSLSREVINEYTPEN

SEQ ID NO: 23212 - protein, 548 aa, Cryptosporidium parvum
MGGQKIKKGTRGDSAMFITRAQAIKRLQVSLADFRRLCILKGVYPREPKKKLSGLDKTYYHLKDIIHLKHDPILSRIRELKIHLRKYRKAMGRNDKTKARSIRENKPIITLQHIVKERYPCFVDALRDLDDALSTCSLFASLGADDNYSIRSNMIKKSTYLIDEFMYLVSELGFLTKSFISIKGFYFQAKILGETITWLVPHQFAQSIPDEVDFKVLSTFLEFYHSLLKFVNFKLYQLNNLTYPPTINTPIFDNGGRFLSLHAYNLSKLNSNIPSNVEQKVEKKRIFEGLTFFISREVPLLPLAFVIKSFGGKVGWENQFSSIKQDDEGITHYVIDRPINFLKSFIDKHPNCEFIQPQWVFDSMNESIRLPTRPYGPGEKLPPHLSPFVDDSTQGYIPTQRQVLDEIKESNSHKSQSCLSEDESTEIDELSEHDSDIEVQQAREDAYFDSIEREQSLSTSNEIDSIDNEHKDSSNFTTESELTNTRDKVNIARKLAKKRKEEEQREQQKTLLKKKHKRLLQRIEYSNKIASEKAERLESRRKLLSKNN

SEQ ID NO: 23213 - protein, 213 aa, Cryptosporidium parvum
MSYLFHAIGHEYSYFDKKNYSKDDWIAKISKSTTVYVGNLSFFTTEEIISEVFGLCGPIKAIYLGLNHQTMQPCGFCFVQYYSHADALTAVTFLNRSYCDGREIRVDWDSGEDISGSRRYGRGNSGFQWRDELRNQIDPDRQLDVVDTNNHSKSYKFSHGSNSSFHRRHPGGRGRNSRGTFNISHYNRQIKHKHQVFDQLKNTNGSHDNYPDY

SEQ ID NO: 23214 - protein, 246 aa, Cryptosporidium parvum
MESFFATNSRKSQFSGNFFNSSDLTSIQQTHLLKMYSSIIAGSFMTVFGVTAFINGMLRINSFVGLLAGIGVTFYLTASSSNKSSISIKRLAAYLLLCFVIGNGLGPLILFSNFVNPVIIPTALATTCIIFISLSFGVLFTKKRLSLYTTSFIFTTIAYLGLVSFFNIFTRSKFVDSLLSYAFVMVYSFYIYYDTQKTLEAIAYGERDFLLHSIQLYLDAVNLFTKIVVILIRKQQEEEEKRRKKE

SEQ ID NO: 23215 - protein, 203 aa, Cryptosporidium parvum
MNKNKYGPTRKTGDGSSSAALAKVLMSKMGLQSQPIISPLKSTKPPLPPKPNLTYGPQPFPLGQVPGPYQSGGSTFPPPPPPPPPPPPPLQAPSNEDFPPPPPPPPPPPPLPSPPPPTLPPPPSLPPYPVPGSQSSMPMPMPMPMPMPMPMPMPMPMPTNQPYAPISQAPRPLPQLGSYFTPRPWKGGDNSSNGPKDSTGDDD

SEQ ID NO: 23216 - protein, 552 aa, Cryptosporidium parvum
MSLICSISGTTPEDPVISKTGYIFEKRLIEEYIRCNNSCPITKSELSLDDLIQVKSKSNLKPRLIKNTSIPGILDSLRTEWDAMAMEMFQLRSELEQTKSQLTHSLYQHDAACRVIARITREKDQAISRLAEIQNSILEKDEDNITSLQSVGGKRIRAEDNFVNIPEDVIDLFTEYSDKMRPIRKKQSFPDLIPAEQVKEFSLKSEIKLKENCNIEVGVAFNDEIYVSGMENGEILVSSIEFDRNEISSIPISYPQNCEQAVSIFAIEKYSGSQYSSKNTSQLLSSLNVLACFQNSNKIHIFSRNQEDDESFNLSLMDFNSSFESNIIINSLEKHPLGMHIIANSSNKGLFSMFDLESRKQLFLHQLEQNNSYSQLKPHPDGLILGGIVPNGNIVDIWDIRNLEKISSLEHPTKNNNIDHNDPNISRNSSLCFSNNGYYLLSTSLDNKIHLWDLRKSAILDSLELSTLPNNSNLILQIDESGKYASCFSKNHFSIFSLFNKHKLQLISSLSNFSNRNNNNNLPDNIHHIHFNQNLNSFSSLCHSGIIRMWTN

SEQ ID NO: 23217 - protein, 366 aa, Suberites domuncula
MAVQVLPENPAKPGYYKMELFKTVWEAPERYQDLSPIGTGAYGTVCSAIDTRYNVRVALKKLARPFQTAVHAKRTYRELRYLKHMKHENIIGLLDVFSPASTFEEFQDVYLVMHLMGSDLNNIIRQQSLTDEHVQFLVYQILRGLKYVHSAAIVHRDLKPSNIAVNEDCELRILDFGLARATDEEMTGYVATRYWRAPEIMLNWMHYGMKVDIWSVGCIMAELLTGQVLFPGTDHIDQLTRILQIVGTPDKEFLDKITSETARTFIESMPNFPRRDFSKFFVGANPDAVNLLEQLLSMDPDRRPTAEEALAHPYFVNYADPDDEPNSPPYDDTFEKLEQDQLGWKKLVRDEITAFQTDPTLYQQSL

SEQ ID NO: 23218 - protein, 531 aa, Pleurotus sajor-caju
MFPGARILATLTLALHLLHGAHAAIGPVGDMYIINEDVSPDGFTRSAVVARSAPSTESTSETGSTPGVLVQGNKGDNFQLNVLNQLSDTTMLKTTSIHWHGIFQTNSTWADGPAFVNQCPIASGNSFLYDFNVADQAGTFWYHSHLSTQYCDGLRGPLVIYDPSDPHLSLYDIDNADTVITLEDWYHVVAPQNAVLPTADSTLINGKGRFAGGDTTALAVINVESNKRYRFRLVSMSCDPNFTFSIDGHSLQVIEADAVNIVPIVVDSIQIFAGQRYSFVLNANQTVDNYWIRANPNLGSTGFDGGINSAILRYAGATEDDPTTTSATSTPLEETNLVPLENPGAPGPAVPGGADININLAMAFDFTNFELTINGSPFQAPTAPVLLQILSGATDAASLLPSGSIYAPEANKVVEISIPALAVGGPHPLHLHGHTFDVIRSAGSTTYNFDTPARRDVVNTGTDANDNVTIRFTTDNPGPWFLHCHIDWHLEIGLAVVFAEDVTSIAAPPAAWDDLCPIYDALSDTDKGGIA

SEQ ID NO: 23219 - protein, 521 aa, Pleurotus sajor-caju
MVLSTKLVALVASLPFVFAVTKKLDFHIRNDVVSPDGFERRAITVNGIFPGTPVILQKNDKVQIKTINELTDPGMRRSTSIHWHGLFQHKTSGMDGPSFVNQCPIPPNTTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVNANQTIDNYWIRAPLTGGNPAGNPNLDVSLIRAILRYKGAPAVEPTSVATTEGHKLNDADMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRVSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 23220 - protein, 532 aa, Pleurotus sajor-caju
MFPGARILATLALALHLLHGALAAIGPVGDMYIVNEDVSPDGFSRSAVVARSVPITGPTPATASIPGVLVQGNKGDNFQLNVVNQLSDTTMLKTTSIHWHGFFQAGSSWADGPAFVTQCPVAPGDSFLYNFNVPDQAGTFWYHSHLSTQYCDGLRGPFVVYDPTDPHLSLYDIDNADTVITLEDWYHIVAPQNAAIPTPDSTLINGKGRYAGGPTSPLAVINVESTKRYRFRLVSMSCDPNFTFSIDGHSLLVIEADAVNIVPITVDSIQIFAGQRYSFVLTADQTPDNYWIRANPNLGSTGFAGGINSAILRYVGAADADPTTTSSTSTPLLETNLVPLENPGAPGPAVPGGADININLAMAFDFTTFELTINGVPFHPPTAPVLLQILSGASSAASLLPSGSIYELAPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDALCPIYDALSDADKGGIIP

SEQ ID NO: 23221 - protein, 525 aa, Pleurotus sajor-caju
MAPLVRALACLAILAVTNVYGATVGNNADIYIANKVIAPDGFERSGVLAGTAAGVEVIGPLVRGWKGNRFRLNVINQLSDSSMLKTTSIHWHGFFQEGSSWADGPAFVTQCPIASGDSFLYDFRVPDQAGTFWYHAHLSTQYCDGLRGAFVVYDLLDPHRLRYLVDNEDTVITLADWYHTVAPQAGLVPVPDSTLINGRGRYAGGPTVPLSLIRVLWGVKYRFRLVSLSCDPNYTFSIDGHKMTIIEVDGVNTKPLEVDSIQIFAGQRYSFVLHANQRIANYWIRANPNLGTRGFEGGLNSAILRYYGAPNRDPTTTQETSVNPLVETNLVPLRDAGAPGVPGVGNADVNINLAMAFDFPSLQFTINGAPWVSPTSPVLLQIISGASSASELLPPGSIYTLPRNKVVELSIPALAIGGPHPIHLHGHAFDVVRSAGSSTYNYNNPVRRDVVSTGTGSDNVTIRFKTDNPGPWFLHCHIDWHLEIGLAVVFAEDTASTSKQRPPKSWSDLCPIYDSLTEEQKGGIV

SEQ ID NO: 23222 - protein, 79 aa, Microtetraspora sp. ATCC 39727
QMGEVDYAAGEPKGTPWHPHRGFETVTYMIDGVMEHLDSNGGGGTITNGDTQWMTAGAGILHKEAPPEWLVQQGGLFHG

SEQ ID NO: 23223 - protein, 528 aa, Kluyveromyces lactis
MSLDTESFETAEKAIEVVTKEMVSLTNYSAIGSLTSQLSQNDTKSGGIEQKKLPLKPILLCLATSFAGFIFGWDVGTIGGITNMVSFQNFFGTNFDSSSNTHYFPKLLIGLIVSIFNISCALGGLFLVKIADINGRKPGIYAAITIYSLGTLIGWTCGSSWWYFFFARFISGLGVGATAVMIPMFIAESAPINIRGAMVVLYQLMITLGILLGNVINYCCRSTLHETDNATWKIPVGLGNVWAAIVALGVHFMPESPVFLTKRLGSALKAKAAFAHMNNLDVDDPIVDSHIRKMMESADAEVSTHNDMKNSRFEFILGQPRLGFRLFIGIMVMAFQQLSGANYFFYYGTTLFNSVGIEDPYLTSILLSSVNFISTFFGIYLVEKLGRKACLILGSAGMFTCMSVYASVGSFALNKSPQNSGAIMVTFTCVYIMFFACTSGPVSFVVISELFPSRTKAISMAVCTSINWLCNFFISLCTPYVTDKIGFKFGFVFAGCLFVSFWFFTFLLKETKNKTPEQVDALYSIDKQ

SEQ ID NO: 23224 - protein, 247 aa, Chlamydomonas reinhardtii
MAEANSRELALYSAKIAEQSERYQDMVEEMKKVAVLANEQELSVEERNLLSVSYKNLVGSRRASWRILQSIEQSEQAKGNEKRVGMIKRYRAVVEGELDKICHEILDLLDKYLVPSASTTEAAVFYLKMKADYHRYLSEYKTDEAKAAAAELTLAAYKVAQEKADELPTTNPIRLGLALNFSVFYYEVMNQPALACSLAKKAFDEAISDLDSLGEDSYKDSALIMQLLRDNLTLWTSEMQDDDKNRA

SEQ ID NO: 23225 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 23226 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEDRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 23227 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAESEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 23228 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVDVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 23229 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREILTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 23230 - protein, 1329 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVAHGDLSRKIERPARGEILQLQQTINTMVDQLQSFATEVTKVARDVGTEGKLGGQAEIAGVKGMWNELTVNVNAMAQNLTTQVRDIAQVTTAVAQGNLTRKVEAQCKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDCEKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 23231 - protein, 1145 aa, Cochliobolus heterostrophus
MAAETYSGVAAIIRNLARQHDPARDPSFSAQVSANGAKTAANAIALPGPESEEKTQLEQELSALCSRIDFLEHKCSHAAAKSGQFPLTPAQESPDDGVLYTPAGAIRNSSAPPGQARRGSNKERAIWVSNWLAAKETNGGPEEPAAALTEEQLNYLRVHLNQQADQIRNQREHIDNLSREVNKQLTTQSMVFEHGIEDIGALKRELGKHQQANLAFQKALREIGAIVTAVAMGDLSKKVLIHAKEMDPEITLFKRTINTMVDQLQEFASQVTFLAREVGTEGRLGGQANLPGVAGIWAELTDSVNMMANNLTEQVREIAVVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRANERKLNLAYDVSYTVPDYVVGDSFRLRQIILNLVGNAIKFTEHGEVKVAISMAQEQDCGPDHYVFQFAVSDTGIGIRGDKLNLIFDTFQQADGSTTRKFGGTGLGLSISKRLVTLMGGRMWVESDFGKGSVFYFTCRVRLGKPEITAIQPQLVAYKQHTVLFVDQGNTGFSDQIIEHLKALDLVPMVVNSVEEVPETTKRADMPYDCVIVDNDKTARELRIAERFKYIPLVMLTPHVCISLRSALENGISSYMTTPCLPIDLGNALIPALDGRAAPLVSDHSKSFQILLAEDNAVNQKLAVRILEKYHHRVTVANNGLEAFEHIQKKRYDCVLMDVQMPVMGGFEATAKIREWERENGIPSTPVIALTAHAMVGDREKCLAAQMDDYLSKPLRQNQLIQTILRCATVGSTIYDHTSEPRYTASSHIPNLDLPGNSKDKATTGAASASTTSPKKRPQLETRGFTDRGGGADSPNLLAVDQTDNGSVERVRSLSASL

SEQ ID NO: 23232 - protein, 636 aa, Sus scrofa
MENKWFLSMVRDDFKGGKINLEKAQKLLEKLDIQCNTIHVKCIFKDNDRLKQGRITIEEFRTIYRIIAHREEIIEIFNAYPENRKILFERNLIDFLTQEQYSLDINRSIVYEIIQKYEPIEEVKQAHQMSFEGFTRDMGSSECLLFNNECGSVYQDMTHPLSDYFISSSHNTYLISDQIMGPSNLWGYVSALVKGCRCLEIDCWDGSQNEPVVYHGYTLTSKLLFKTVIQAIHKYAFITSDYPVVLSLENHCSLSQQEVMADNLQSVFGDALLSDVLDDCPDRLPSPEALKFKILVRNKKIGTLKETHERKGFDKHGQVQECEEEEEAEQEEEENEVRDSEILDILQDDLEKEELKRGVGIKFFKKKKVKIATALSDLVIYTKVEKFRSFHYSRLYQQFNETNSIGETQARKLSKLRASEFILHTRKFITRIYPKATRADSSNFNPQEFWNIGCQMVALNFQTPGLPMDLQNGKFLENGNSGYILKPHFLRDGKSIFNPNKAPINSNPITLTIRLISGIQLPPSYHSSSNKADTLVIIEIFGVPNDQMKQQTRVIKKNAFSPRWNETFTFIIQVPELALIRFVVENQGLITGNEFLGQYTLPVLCMNKGYRRVPLFSKMGESLEPASLFIYVWYIR

SEQ ID NO: 23233 - protein, 274 aa, Triticum aestivum
  unsure (1)..(274): unsure at all Xaa locations
GAXSTVVYCVSSSYXALLFIYIPVLRRAPATYRRGMAATATKLSXGHEMPAVGLGVWRMDSAAVRGLIHSALRAGYRHFDCAADYKNEAEVGDALAEAFETGLVKREDLFITTKLWNSDHGHVVEACKDSLKKLRLDYLDLYLIHXPVATKHTGVGTTGSALGDDGVLDIDTTITLETTWHAMEDLVSMGLVRSIGISNYDIFLTRDCLAYAXIXXAVNQIETHPYXQRDSFVKFCQKHGISVTAHTPLGGXTXNTEWVXLGLMPRRYCIQVPG

SEQ ID NO: 23234 - protein, 295 aa, Triticum aestivum
  unsure (1)..(295): unsure at all Xaa locations
RXXVVAIEDKXLYEGDWISLNGSTGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAESGAAEDDVLARMEKLSEVNPMLGFRGCRLGISYPELTEMQARAIFEAAISMTNQGIQVFPEXMVPLVGTPXELGHQVALIRQIANNVFTNMGKTIDYKAGTMIEIXXAALVAXXITNRLSSSLSDNXLRR

SEQ ID NO: 23235 - protein, 333 aa, Lilium davidii
MSKARVYTDVNVIRPKEYWDYEALTVQWGDQDDYEVVRKVGRGKYSEVFEGINVSSNERCIIKILKPVKKKKIKREIKILQNLCGGPNIVKLLDIVRDQHSKTPSLIFEYVNSTDFKILYPTLTDYDIRYYIYELLKALDYCHSLGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGADELNTYLNKYRLELDPQLDALVGRHSRKPWSKFINADNQHLVSPEAIDFLDKLLRYDHQDRLTAREAMTHPYFLQVRAAENSRTRPQ

SEQ ID NO: 23236 - protein, 221 aa, Griffithsia japonica
ARGSLGSIFSVYYRKSAPGKEGDTSDLLQRPGFEQVAAGYCVYGSTTYLTFSMGYGVHVFILDTLSGHFVLAKQHVQTPKAGPIYSVDTSVLPNVVDGVRKYVDLLEAEGSGKKFRHLNNLVANFHNVLTKGGILMLPGPQKQDLAKFLTEAAPLAFVARQAGARASVGKRNLLELSAWSLEMSVPLFVGSTADVDRLEEMVLGHAVEEKNSVDPSTMHKI

SEQ ID NO: 23237 - protein, 154 aa, Griffithsia japonica
HEARLHPRLYTPHTHHTSFLSRANQPPPHTMSGKVKKTSQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKSKGDASQEV

SEQ ID NO: 23238 - protein, 124 aa, Griffithsia japonica
MSAKVKKASQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKTKGDASQEV

SEQ ID NO: 23239 - protein, 103 aa, Griffithsia japonica
MSGRGKGGKGLGKGGAKRHRKVLRDNIQGITKPAIRRLARRGGVKRISGLIYEETRNVLKVFLESVIKDSVTYTEHARRKTVVSMDVVYALKRQGRTLYGFGN

SEQ ID NO: 23240 - protein, 1177 aa, Methylococcus capsulatus
MSEDLTSPPAMRQRFLRSLGSICLIVILAEVIVMTLLGAFHRGGLELVRWQESALDGLLLGLFSAPLLWIMALRPLAQQIARESQRNKELLDALDAHALVSITDLQGRILYANDNFCAVSRYGREELVGQDHRIVNSGYHGKAYIRDMWRTISRGNIWQGEFCNRRKDGTRYWVDSTIVPLMDNAGKPRQYISIRRDITAQKEAEAQLARLKQAMDANSEMILLTDRAGRIIYANPALCRFSGMAEGELLGQSPSILDSPLADQETLAAMQEALQAGQPWSGRLLNRRRTGPAPHDAEDYWAEISTTPIHTDGNGLVGYVQIQHDVSARVERERALAMEQEDTAARLRITETLQQSAPLDERCRQVLRILFELGTFGLQRKGGIFLKAEHGNCLKLFVLEGKFCDEFVRREQTIPMGACLCGRSAVSGEILVSDDCFQDHRHEHRFEDMESHGHYIVPIASGGDLLGVLFLYTDPNPTRSEARMVMLRQVGEMLALAILEDRAKASLKAAHDAAVDAAQAKSAFLANMSHEIRTPMNGVLGMLELLKDTDMSREQWDLVETASNSAESLLEIINSILDFSKLEAGKVEIERTEFNLPDLVEEVCALLAGRAHDKGLELNCFLPADLPRMWIGDPTRIRQILTNLLGNSVKFTERGEVSVKVMQGEAGAKRTDLSFEIRDTGIGIAPDVQARLFQPFTQADGSTSRRFGGTGLGLSICRNLVELMGGTIGLESAPGRGSRFWFTLPLEPLPGASAPALPDFSHRRVLVVDDNATNRVILSHYLTHWGLEVDEAERGDTALNRLRTALHESRPYDIVLLDLHMPYMDGHELARAMNAEPGLKDTPRLLLSSGGLTGEAELRALGIARSLLKPVRQSLLFNAIAEVLAAKATVQRRPAAKTETVLPAYEGRRVLVVEDNRVNQKVIVAMLGKFGIVPDVADNGQAALELLARSSYDLVLMDCQMPVLGGYEATGELRAREMSAGGRRTPVVALTAHAATGEREKCLAAGMDDYLSKPISRDRLAEALERWLGHPAAPASAETGQGAVNDDGGDRPAGLSWNREETLARLDHDEALLAEMIALCIEELPRHLAALQEAGAANDIAALADAAHAIKGMAGHFCAGSVRDLAARLEDQARKAGSMPDAASIGALETAAARLLEDLHGGSPAGDPAKGTNDAAQ

SEQ ID NO: 23241 - protein, 194 aa, Griffithsia japonica
ARGLYPSIMPLQNVNGSASQSLQDFKGVTDKSAVQVVEEKLQNMNKASVDPNCIMSDSELAGFLELYGRYMTERSKKAQINWDLIEQPSENMLQRYDTLIAASDADRTALLSKLAVLKLNGGLGTSMGCKGPKSVIEVRGDTTFLDLIVQQIEGLNKSHPGADVPLLLMNSFNTDTETARIIPKYQHTNVTSPL

SEQ ID NO: 23242 - protein, 174 aa, Griffithsia japonica
MSTNTATLQSGAKMPLNGFGTWKASVEETEQAVTAALRAGYRHIDCAAVYWNEAAVGTAISKAISGGVVKREDLFITSKVWNTCHATDKVVDSCRQSLKDHQVDYFDLFLVRDIGVSNYSVALLVDTLNYARIKPSVNQCEAHVYFARPQLRDVCREFGVHLPCTPSSQRPKGR

SEQ ID NO: 23243 - protein, 172 aa, Griffithsia japonica
HEAFRISTMTNSATVHPPPWTPPEDIRSAADVQRHILALTRDSSLTEHEKSRRRQLIHSALFRRLQRARHDSIASELSDKASAKPFSNVLDPKTNQRLLGCRHYPRNCKIEAACCSLWFVCRICHDEHPGLDHAIDRFATKNVRCMHCDNVQPVNSSAHSCTSCGTRFALYF

SEQ ID NO: 23244 - protein, 113 aa, Triticum aestivum; identical to SEQ ID NO: 1711

SEQ ID NO: 23245 - protein, 249 aa, Triticum aestivum
MAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 23246 - protein, 187 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKVAIGIFYRKKLKPFVI

SEQ ID NO: 23247 - protein, 249 aa, Arabidopsis thaliana
MGRGRVQLRRIENKIRRQVTFSKRRTGLVKKAQEISVLCDAEVALIVFSPKGKLFEYSAGSSMERILDRYERSAYAGQDIPTPNLDSQGECSTECSKLLRMIDVLQRSLRHLRGEEVDGLSIRDLQGVEMQLDTALKKTRSRKNQLMVESIAQLQKKEKELKELKKQLTKKAGEREDFQTQNLSHDLASLATPPFESPHELRRTISPPPPPLSSGDTSQRDGVGEVAAGTLIRRTNATLPHWMPQLTGE

SEQ ID NO: 23248 - protein, 145 aa, Neurospora crassa
MLNTRQRSTVERLDRPSAYFFNKVYELFSKCGEIKRLVMGLDRLQKTPCGFCFVEYYTHQDALDCMKYIGGTKLDERIIRTDLDPGFEEGRQYGRGKSGGQVRDEYREDYDEGRGGLGRQIQAERMREHDHKRYDDNDEQYGRLR

SEQ ID NO: 23249 - protein, 103 aa, Neurospora crassa
MTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 23250 - protein, 479 aa, Neurospora crassa
MLLTHPITRPQRLIAGKLESLIGVSYAVGARRHGQPSAAGATRCFYSTAPVNPFPAANPSTSNLVRGCDPAVGCFSLSASNLIPVNNSFHTTTPSRFSIRSNPFSKMAATKDYRLLCLENPLLVRAHPGFPYSQSASQHHGATLRPPSFARTCMMQALLEKYGLKANDAILAEEKHQGLFEDLLQNYDAKLIAGGAAQNTARGAQYLLPPNSVVYLGGVGDDKYAAILHDAVKQAGLRVEYRVDPKISTGRCGVVITGHNRSMCTELGAANHYDLEHLKKPEVWSLVENAEVYYVGGYHFTVCPPAIMELAKQAASGNKPFILSLSAPFICQFFKEPLDASAPYWDYVIGNEGEAAAYAESHGLNTTDVKEIAKALANLPKENTQRKRVAIITQGTEPTIVAIQGEDEVKEYPVHSIDPAKINDTNGAGDAFAGGFAAGVVEGKSIEESIHMGQWLAKLSIQELGPSYPFPKQAYPGHN

SEQ ID NO: 23251 - protein, 637 aa, Neurospora crassa
MTSSLAEHPDRARPAGNEGHQQQSEQPKSRREEPASRLSTGRRDGASEDTNQQFLVGEQSPLLSPVDNQDGSSSDQGADSADEFQTTKSVWYMILLTISIGGLQIAWSVEMSNGSPYLLSLGISKSLMALVWIAGPLSGTLVQPYVGMMSDNCRIRWGKRKPFMLGGAAATILSLMFLAWTREIVTGILGLFGADPQSESVKLCIICTAVLWIYILDFAINTVQAAIRAFIVDCAPTHQQEMANAMASSLALGTTVLMTCLFIKERDPRLEGPPAKDKPGVVAFFKKIFTSIKRLPPQTKKVCQVQFCAWIGFFPMLFYTSSYIGEIYAEPYLEENPNMTDKELDDLYERATQVGTFALLIFAITSLATNIFLPFFIAPTYDQSMVTAVAPGEAPAVVIKDYEPEQRSWTRHLIIPGFTLRRAWMFSQILFTGCMLCTVFVRTVTAATVLIGLVGITWALTLWAPWAIISAEISQRDEERRSQQQRLSPSRLDNLDGYSSDGNQDSDLGKDDEEAADQAGVILGIHNMAIAAPQIIATVASSIIFRLFQKPRGTPGDHSIAIVLALGGITVLISALFIHRIRDEPTVTYDEISAVEEGDAAPRPNVHSRSRSFDQPPRASLERATLVRNKSFGGMEY

SEQ ID NO: 23252 - protein, 692 aa, Neurospora crassa
MSNQSSLLAKHRHPVPAPLCTSLKARPNSGHAFNLSNFWRLWTNTDNIWTGIRRNKSFHGVAAPSPLLSVELHLLLSPTRRSPGNLRQARNHQCRPTEHQHNLAMLSEVIAGSLAELATENPTKQEMYSAMAIFIFILLLMTAFFTSYIMQERKIQAVHETVVSIFAGMVVGLIIRISGSDNIQSLLRFSPQIFFNLLLPPIILSSGYELHQANFFRNIGTILTFAFAGTAISAVVIGVLLWLYTRIPLEGLEVTFREAIQVGASLSATDPVTILAIFNSFKVDPQLYTVIFGESILNDAIAIVIFESAQHADGNGQRIGVVSIIHGIWYFLKEFFGSLAIGSVVGILAAVLLKFTYLRRYPKMESCMIVLIAYSTYFFSQAIQMSVLSVCAARWLAVFPLSRLINWFIRYRARRHGREAADVLPYNYQAMLFWAGLRGAVGVALAAAFTGKSRFALQATVLVVVVLTVIIFGGTTARMLEILEIKTGVVEEIDSDDEFDIEAIHGGTWHKRSGTGIGFSAPRRGSTVPLGNLDSERNGSPGSRSGWASGHRSPNPMPRRQSSRLDVKNGNDHERVDLLGVSGNNTDSEIGSDIDTSDLPPPAPRRRPSPIPGGGNADLEAGPGERGSGWNRSTSNNEGGQSLSATAAIRQLFSSEDPTALFRQFDENYIKPKLLLDGGTGRGGHGGPSGSG

SEQ ID NO: 23253 - protein, 554 aa, Neurospora crassa
MRISASTVLLGAASAASAASFQNQAQHVLADNFHKAHDAVKPVADSFAHTTLESFEEAFNGMNSQAKALWDEIKLLVPENAFDKPTWFSKPKAAKRRKDWDHVVKGADVQKLWVKGADGEKHREVGGQLDNFNLRVKSVDPSKLGVDKVKQYSGYLDDEENDKHLFYWFFESRNDPKNDPVVLWLNGGPGCSSLTGLFLELGPSSIDKKLRVVSNEYAWNNNASVIFLDQPVNVGYSYSGNAVSNTVAAGKDVYALLTLFFHQFPEYAKQDFHIAGESYAGHYIPVFASEILSHKDRNINLKSVLIGNGLTDPLTQYEHYRPMACGEGGYPAVLSESECRSMDNALPRCQSLIRNCYESGSVWSCVPAAIYCNNQFIGPYQRTGQNVYDIRGKCEDDSNLCYSALGWISDYLNQKDVMDALGVEVEGYESCNFDINRNFLFQGDWMQPFHRLVPGILKEIPVLIYAGDADFICNWLGNKAWSEALEWPGKNGFNKAELEDLSLPKADKEYGKVKSSGNFTFMQIYQAGHMVPMDQPENSLDFLNRWLGGEWFEQ

SEQ ID NO: 23254 - protein, 304 aa, Neurospora crassa
MSVPRLIRKIFLATEQAEGAGARVRRSIGTPQLRNFSPFLMLDHFTIRPGSGFPDHPHRGQETITYLLSGGVDHEDFAGNKGTIEAGDLQFMTAGRGIMHAEMPRQNPDGSANVGLQLWVDLPKELKSCEPRYRDLKAQEIPTVETDEGRVKIKVISGKSHGVDSVKDLAYTPVWILDVEVKPGGKVVQEVPEGWNAFAYTLEGTAIFSSGKDGEKRTVEQFHNVVFEPQGEAVYAEVDAGAEKPARFVLVAGTPLDQKVVQYGPFVLNSQEEVYQAFVDYQTHSNGFERAQGWRSEIGKSMRH

SEQ ID NO: 23255 - protein, 693 aa, Neurospora crassa
MRILSRIALLSLTTAAAHAATVVYDFNVSWITANPDGLAERPVIGINNQWPPPRIDVQVGDRLIVNLHNSLGDEDTSLHFHGLFMNGSNHMDGPVMVTQCPIPPGASFTYNFTVDQPGTYWYHSHNKGQYPDGFRGPLVIHDPKAPFEYDEELVLTVSDWYHDRMSLLQPRFMSKYNPTGAEPVPKSALMNDTQNLTMPMVPDRTYLFRIANIGAFAGQYIWVEDHTITVVEMDGVYVHPTETNMVYVAAAQRCSFLLTAKKETSRNFPIIASMDTTLFDTIPPGLNTNVTSYLLYNPTAPLPLPTPLDSLTPLDDTLLFPQDNLTTLPSPDQTITLNVTMNNLASGANYAFFNDITYVPPRVPTLYTVLSSPNSSSSQDMDLTTNPSIYGTYTHPFILSHNSIVQIVLNNLDSGRHPFHLHGHQFQILHRSGADEGTWSPSSSSSSSTSSFSTSNGSNHTAPMRRDTLVVEPNGNAVIRFQADNPGVWLFHCHIEWHMISGLAVTFIEAPSVLQQTINLPADHLAACRDRQDPIPFEGNAAGRGGKDKNDLSQWLVLDGQPSPPKPIPAGFTGGGIAALTMSCFTGILGVAVVAWYGFSEPVGESNTAAAMVKTKSPAAAGESGSESGVYTDVDVDSAGKSASVVRVKRGTEAVESEALSFGSEEEAVNGVGMATSKKGDGVVVDVDAITRA

SEQ ID NO: 23256 - protein, 286 aa, Neurospora crassa
MADAQLNDFPSLFSVKGKVAVVTGGSRGLGLSAASALLQAGASKVFISSRKASACDSAVKTLNALPGLAPGAKAISIPADAATLSGVQHLVSEVAKHTDHVDILLANAGATWGAPFDEHPDSAFAKVMDLNVRGVFNTIREFAPLLQKKASVEDPSRVIITASVAGLGIGTIGKQGTYGYSASKAAVIHLGRNLAVELGPRGITVNSICPGFFPTKMSNGLLDMSGGKESIAAANPMKRLGRPEDIAGVVVYLASRAGAHVNGATIAIDGGAMWAKGQLNVESAKL

SEQ ID NO: 23257 - protein, 1171 aa, Neurospora crassa
MDPPASKDGPDGSSLKPVSSLLAKFENMNKAGDTQQSSSSSARTTSPAPKPDRLRDPSPLGAREPPAIPTRPIKDRANIPTLQPQYTGVSVASTGYASSPIRSVPPPISSLAPRPAQPPFLNVQPPQSPSRNVDGVAVGERPPFLQTDSLAKVASPPTASKQFKIPSRPITPATSDPQRSPRLAATQPPSPPPPRRSVELQRPRDVEKPRPVPPPINRAEKPVIPSRSSVQIERSQALDIKTRTPERISPFSSPPSSNGTPDEDSSPPMLPARPRAQQQREPNPEGLQRSRTFHVGFDPPPLHPSAARQRRGREEEMGSTRGPVTRHHTGGNRPPALPARPHSIIETSRTLNGMMMAPPPRPPKPGVNANLDPNPPGSISQKRIVSTPNQYHPSVPSRTHVRSMTVDRTSNRVPNEFRAPPTPISAATHDRIPERIPEVVPVTSSRTANTGPTITMAYPDATNTNRSKPYISKGVHEIYTKYDTRMLDVCGELVCTTGGFTRVWSLLDGELVMSLSMGEGQKGTAVMFKPGAHVDDEGTKVWIGNNSGELLEADIGTQRITDSLPNAHGRYEIIRIYRHFNEVWTLDDSGALNVWGPDESHTPTLSNGPSQSFRVPRGHTFSMVVEDELWYATGKDIRVFKPTVDGKTQFQVLLRALCQQDAGEVISGAVLASDPDMVYFGHSDGKVSVYSRKDYTCQCIMNVSQFKINSLAAAGSYLWAGYNNGKVAVYDVTQTPWAVKKEWVAHENPVIKLIADRSSSYKLDRYQVVSLGADNMVRTWDALLQEDWLEGEMKRKDVEYCEFQNLKVLIMTWNAGASTPHSLRYSDSDANFFRDLLQTADSPDIIIFGFQELVDLEDKKATAKRFLKPKKKEGSDQERMSHQYRDWRDFLIRSLDDYMQGDLYHLLHTSPLVGLFTCIFVKADLRGRISNLSSNEVKRGLGGLHGNKGAIVVRFLVDDTSLCFINCHLAAGQSGANQRHNDVAAILDASAFPSERDPAVRIDSYVGGGDGTMILDHELCVLNGDLNYRIDTMSRDTVVTAVKQGNLTKLLERDQLLVAKRRNPGFRLRAFDELPITFAPTYKYDVGTDNYDTSEKKRSPAWCDRLLYRGRGRIEQLDYRRHEVRVSDHRPVSGRFRFLVKRIDPRRRAQAWMECQQLWEDLRAKEAYAEK

SEQ ID NO: 23258 - protein, 438 aa, Neurospora crassa
MPISKIHARYVYDSRGNPTVEVDVVTELGLHRAIVPSGASTGQHEACELRDGDKTKWGGKGVLKAVQNVNEVIGPALIKENIDVKDQSKVDKFLIDLDGTPNKTKLGANAILGVSLAVAKAGAAEKGVPLYAHISDLAGTKKPYVLPVPFMNVLNGGSHAGGRLAFQEFMIVPSAAPTFSEALRQGAEVYQILKSLAKKKYGQSAGNVGDEGGVAPDIQNPEEALDLITEAIEKAGYTGQVKIAMDVASSEFYKEDVKKYDLDFKNPESDPSKWLTYEELANLYSELCKKYPIVSIEDPFAEDDWEAWSYFYKTQDIQIVADDLTVTNPLRIKKAIELKAANALLLKVNQIGTLTESIQAAKDSYADGWGVMVSHRSGETEDVTIADIVVGIRSGQIKTGAPARSERLAKLNQILRIEEELADNAIFAGEKFRKAVEL

SEQ ID NO: 23259 - protein, 364 aa, Neurospora crassa
MAAATRSVRMASRLTSFSRPSALFAQRASVAQRAAFSVSTRNLKSEVVKETEVPVSIYSGDAKGAASSNTGDHFSIPVKPRQQVAESEPDDHVQPLEDKVYRQMPRTLQKMSVMGKVIIITGGARGLGNYMARACAEAGAKAIVIFDANQDLGDESAAELHQKTGLPVSFFKVDVRDGSAINAAVQNVVDLYGAPDVLVNSAGIADSNIPAEKYDAAMFRRLIDINLNGSFLMSQAVGRAMMAAGKPGSIILVASMSGTIVNYPQEQSCYNASKAGVIQLGKSLAAEWAKYNIRVNCISPGYMDTALNKVPALDAQKKIWKSLTPQERLGAVDDLNGLCVFLASDASSFMTGSNVIIDGGYTLY

SEQ ID NO: 23260 - protein, 417 aa, Neurospora crassa
MRGSTIRPKAQCLRSLSKGLTKRPSAGLRSVPVAATLAPSLPSQRAYSTHPPHAKLNLPTDYSTTPLLAQTSQSALNNPELSPEVRNGPTKRMNMFQAVNDALSVALAQDESVLIFGEDVAFGGVFRCTGKLADTYGADRVFNTPLCEQGIMGFAIGVAAEGMRPVAEIQFADYVYPAFDQLVNEAAKFRYRDGSCGRSAGGLTVRMPCGGVGHGGLYHTQSPESLFTHIPGLRVIMPRSPIQAKGLLLSAIRSNDPCVFMEPKILYRAAVEQVPTGSYTLPLSKAEVLKEGKDVTIISYGQPLYKCMDALQKAEKDFGVSVELIDLRTVYPWDKETVFQSVRKTGRCIVVHESMVNAGIGAEVAAAIQEDSETFVRLEAPVARVAGWSIHTPLMFEALNIPDVARIYANIKKVLNF

SEQ ID NO: 23261 - protein, 186 aa, Neurospora crassa
MSHTVNSSTMNPWEVEAYQQYHYDPRTAPTANPLFFHTLYAPGGYDIMGYLIQIMNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETE

SEQ ID NO: 23262 - protein, 219 aa, Neurospora crassa
MRSFLPLLSLGAVAQALHFFIDGTSPKCFYEELPKDTLVVGHYTAEEWDDQRHSWQKHDGINIFISVDELFDNDHRVVSQRGGPGGKFTFTAAEAGDHRICFTPTSTSGRSSWMSVNNPNGGIKLTLDMAIGESSAIESADKGKLQDLATRAKDLNNRLQDIRREQVFQREREAEFRDQSESTNARIVRWVLIQLVVLGVTCAWQLSHLRSFFIKQKLT

SEQ ID NO: 23263 - protein, 601 aa, Neurospora crassa
MAGNGSLSGLASRVSAIERIPSTPSLSEIQRPRKLRLLIAANGPRDVAFAQAIAVRLSKEPQITTRAIVDDMTHRLAQEIMVYKNRNLRANGPDGLTGKEVETYQQQADELVEWADLLVIAPIDADHLARMMCGMADTLLLEVLRGWDASKRILLIPGMTTHMWENPMTKRQISKLHRKWSWIRVLPPILWHYDDGPNPKRIVKWDAFNEVLAIIKNQADLLKIGHTVEVSVQQGTSAATGKKARSTLPPELWSMIFEYTNDWELATSMGVFTTIPMPESEGWRLQPKDPNDPLQVFMHELEWTLLTANTKAICEKLSQAPESFQDLSALAVHLIFKFGLTEVLTYIESNFPHLFKCFDGKTIPTKASAYYYRTDILEWWARSPSFLEKQYDTEALNLASMRGSIPVLEWWRRSGLPLKYTESAFELATSRGHLDVLQWWRDASQREHPSRNISLKPGRSLLMAAQYGHVEIMRWWLEQSGVPLEHQEHVCKIASRWGQVKILDLWRELRGDDKMQFDNQILIEPTFHAHIPVLEWWRRYAHGELPGMNGRKGKRVEYKTMDIEEALEDSLGDQTRVRRWWAENGLNLGLGTSEWMKVRYL

SEQ ID NO: 23264 - protein, 418 aa, Neurospora crassa
MTLTDAQISIVKSTAPVLKQHGEAITTVFYNDLITENPSLKNIFSLTSQATGAQPRALAHAVLAYATYIDNLSALSEAVARIAHKHVSLQVEPAQYAIVGQYLIQAIGKVLGDAATPEIVDAWTAAYGVLANVFIGVEGGMYEENEKKDHWKGWRKFRIARKVEESSSISSFYLRPVDGATLPKYLPGQYVSVQVLVSQLGYLQSRQYSLSEAPKEGGMEEYRISVKREEGETGAPGLVSNLLHGMQEGAEVEVSHPQGEFFLDPADASKEGVPAVLISVGVGATPMMAILKSLLQENVKRRPVSWIHASKSSSTQPFGEEVRRIVKENPEQVSAHVFLKTVAGTDQAGVHYDFADTRMDLTKLDGERDLHLADKRTEYYICGPETFMVETRKVLVGLGVDKSKVHLELFATGFVADE

SEQ ID NO: 23265 - protein, 829 aa, Neurospora crassa
MADYDRRGGGGYNPKKRRYRDDDDGDRRGGPRRRFDAPPHVRVRKQLLAIAENPMRPWHEEVQSIANLFTDNWDDELLRTNFVDLVLQLAVEQPMKTPFLAAVVLVANTNKPQIVDMLLAKLTSTLETKIAEGDWRDVKLYLKLAGCLQSCLEGDGVFPVLEELFSRAVDLQTASSEDTIGTELVKIILLTLPYVMVTGPTQWQQKAADLMEKTEIIAGEAHPLQALIEPYHPEAGDQSPVASQSCISLLQTQLQNEANNGWALSCLPRPWELPVEEVEQQEKIANAEKHTLPPISIPQTVVAGPRPLFPEIYFSVYANQDVESTPPLTNIAASLIRDALVDTINVLNFNRNVTARFLIELDCYFAPRTFAARATPFDKIREIEPPKSSWKPEDVAVDAVFSQLFSLPNPEHKLVYYHAVLTEACKLAPAAIAPSLGRAIRFLYRNSHRMDLELSNRFMDWFSHHLSNFGFTWKWTEWVDNVYLSNLHPDKAFIMGAIDKEIRLSFAQRIKNTLPEPYQSLIGPEKEKDVPDFKFADDKTPFAAEGKEIAALLRRKAPEEEIEPVIERIHSLALDNNLDPLVASTDVFVTSVLHVGSKSLSHVLAAIERTKERLTDAGATSEAARTQIISSVMEYWSAHPGVAIAIIEKLLNYSILTPQAVINWAITTYAGATRGEALAKGFVYEMVFNTVVKVTSRLRQVLQKATLPEAMIDDETIEAEINGMRSLFRAIEDALFAWASGSKDEMLEASDGLGEGDGTSETEKLVKRWGERWLRVFKRRAAIEEAFIVEARKERERKAAAAAAELAAAPAQEDDMAVDSVDAAAEVTA

SEQ ID NO: 23266 - protein, 260 aa, Neurospora crassa
MLQAIDNIHDRQFLAAELASSATLAAELAQPEIKNILLAYVTPVPLKLYRSLPEIVKALARHGDKIRIRIILTHFAKHFLGGQSKEQPVYSSLLDYPHVEAIYDDADEWGPEPWQRGASILHIELRRWADILVVAPLSANTLAKIVNGMSDNLLTSVIRAWDTDSSIDNKKKVIMVAPAMNSAMWRHPITAKQIRVLQEEWGVRDPEPSEGDTAGVAVANGWFQVIMVWLPSTLACGDTGGAMASVDTIAEAIESRLGLE

SEQ ID NO: 23267 - protein, 659 aa, Neurospora crassa
MAATTTTTNAGRSMASWKRLSTLIAAFTLSWTSSFVAAAGSADYFVHDLPGAPDGPLVKMHAGHIEVTPDNNGNLFFWHFQNKHIANKQRTVIWLNGGPGCSSEDGALMEIGPYRLKDENTLVYNDGAWNEFANVLFVDNPVGTGFSYVDTNAYIHELTEMAANFVTFLERWFALFPEYEHDDLYIAGESYAGQHIPYIAQAILERNKNAGPVNRKWNLSGLLIGNGWVSPKEQYDAYLQFAYEKDIVKKGTDLANKLEIQQRICQKEIAVKPDKIDYPECEAILQDMLQLTAGGVGASGKNQCYNMYDVRLKDDYPSCGMAWPPDLKSVTPYLRKKEVIKALNINDNKSTGWTECNGQVGMNFNPKTKPSITLLPDILSAGVPILLFSGAEDLICNHLGTEALISNMEWNGGKGFELTPGTWAPRRDWTFEGEPAGFWQQARNLTYVLFYNSSHMVPFDYPRRTRDMLDRFMGVDISSIGGQPTDSRLDGEKLPETTVGGAAGNSTSNQAAEKAKLEMAKWEAYRKSGELVLVIVIVAAGVWGWFVWKERRKTAGQGYMGVATGERHSISNNPGPRGNLSGGGDRTRGQGLAGFRNKRSGRRDVEAQDFDESELDDLHLSKPEDPHADSRYSIGGASDDEEEQKPGKGSSSRQPGGRS

SEQ ID NO: 23268 - protein, 301 aa, Neurospora crassa
MAFHKLVKNSAYYSRFQTKYKRRREGKTDYYARKRLITQAKNKYNAPKYRLVVRFTNRDIILQIVSSEITGDKVFASAYSHELKAYGIEHGLTNWAAAYATGLLLARRVLKKLGLDETFKGVEEADGEYKLTEAAETDDGERRPFKAFLDVGLARTSTGARVFGAMKGASDGGIFIPHSENRFPGYDMESEELDAETLKKYIFGGHVAEYMETLADDDEERYKSQFNRYIEDDLEADGLEDLYAEAHAAIREDPFKKAESEAPKKTKEEWKAESLKYKKSKLTREQRAAGVQERIAALRSE

SEQ ID NO: 23269 - protein, 289 aa, Neurospora crassa
MAERQLTQILTQLQTSASSLSYTDSSALLSKAKLLLLQLNALTPTAPGSASNPSLFSLARQVYEQGALASIRAKNPDAFLRYVSQLQGFYELESTVGTGAAGGRIAGADANREEKNKVTGLYLLLLLTQGQYAEFHSELEALSTRLGGATRELEADRYLGYPIKLERWLMEGSYDRVWKAMKKGEVPCEEYGVFSEILTFQIRSEIASSSERAYPSLPISSTKSLLFLESEGEVVEFARSRGWVLKDGHIYFPSAEPTTEEAGAEQEKPFSRLIIENTLGYARELETIV

SEQ ID NO: 23270 - protein, 155 aa, Neurospora crassa
MPPTIPSRGGPSGLKHRHSVSGKSVLSGASGKGKGQGGVGIKRHRKIIKDTIRGITRRGGVKRISAGIYDEIRAALKERLQMILRDCVTYTEHRHAKTVTVTDVIFALRRIGKPIYGFDPETWEPPARGAHRRALAQGGEQGRSGTRGGDNDDSD

SEQ ID NO: 23271 - protein, 701 aa, Neurospora crassa
MSEHPFQIPGLGQARPNEQLPADNFAPDLLVAAASIVGQDVLAVNSADPAQLLGLPKPKTEEKKDENAMDVDSKQSDSTPAKAQEDVSMTNHGDNKQQTASENPAASNLDSPPSPDVTSTLEAALNGMLDAPASSANMTNGDQDGVQEEEHPEWEEDSSPYESSSESSSDSSSDDDSDDEDAHPVLGVEETVRMLMAGLDEEDEDGPNKGKGAGAPLRTKNEIVEEIIPKPEVVITPEMKIEPLAHVEFIVENTVVMKSRVPGEVKVLDLGSVLCKEDRTVIGALAEIIGNVKSPLYTCAFANQDEIKELGLEVGTQIFYSVEHANYVFTQELKKQKGTDASNLHDEEVGADEMEFSDDEKEAEYKKQLKMKKRGGKAGRGGLREQVLRDQSYAPSTAYAPSASSATLDHSPTVSSATLNYDEDDDGPYRPLARPVGFGQGGPPSLPPKPEVGFNAAHGVQGQRGGFSRGNRGEFRGRGQRGGYRGADRKPGGHRAGRGGAAAPSYGGYESTSAPPPFPNTQLPPPIPPNAQIPPPPFGATPGAAPPMPGGHWPHIPIPFPPPPISFPRPSTQSPVPPPQLAGAFNFNFQAWNQAQGQPYQYPPQSSSSSASAPQQQSSTPSYPHQAPTVPPVWSGVPPPPPISGAYVNPNFFQQLQAQHAQQPQQPQQSQQPQQQQQQQQQQQQQQQYWGQHNAYGQAPK

SEQ ID NO: 23272 - protein, 619 aa, Neurospora crassa
MKFLGIAALVAGLLAPSLVLGAPAPGTEGVNLLTPVDKRQDSQAERYGGGGGGGCNSPTNRQCWSPGFNINTDYELGTPNTGKTRRYKLTLTETDNWIGPDGVIKDKVMMVNDKIIGPTIQADWGDYIEITVINKLKSNGTSIHWHGMHQRNSNIQDGVNGVTECPIPPRGGSKVYRWRATQYGTSWYHSHFSAQYGNGIVGPIVINGPASANYDVDLGPFPLTDYYYDTADRLVLLTQHAGPPPSNNVLFNGFAKHPTTGAGQYATVSLTKGKKHRLRLINTSVENHFQLSLVNHSMTIISADLVPVQPYKVDSLFLGVGQRYDVIIDANQAVGNYWFNVTFGGSKLCGDSDNHYPAAIFRYQGAPKALPTNQGVAPVDHQCLDLNDLKPVLQRSLNTNSIALNTGNTIPITLDGFVWRVNGTAININWNKPVLEYVLTGNTNYSQSDNIVQVEGVNQWKYWLIENDPDGAFSLPHPIHLHGHDFLILGRSPDVTAISQTRYVFDPAVDMARLNGNNPTRRDTAMLPAKGWLLIAFRTDNPGSWLMHCHIAWHVSGGLSNQFLERAQDLRNSISPADKKAFNDNCDAWRAYFPDNAPFPKDDSGLRSGVKAREVKMKW

SEQ ID NO: 23273 - protein, 573 aa, Neurospora crassa
MWSLLVSLALLCFGTVARAAVVTINWNVTWVWASPDGFGRPVIGINNQWPCPKLEANVGDTLIVNLHNGLGNQTTGIHWHGINQLQTPEMDGPSGVVQCPTPPGSSVQYKFVLDEPGTFWYHSHEKGQYPDGLRGPLIVQDPNDPYKGRYHSQSIPLVQNMLSPANTRFAPPFPDTILLNDKKDVKFNFVKGKTYRVRLINMSAFASAFLWIDSHPLTMIMSDSTYLQTETAYQLHASSAQRYDFLISAIDRDSGNYPILVALDINRDFRNQTLAPAFPHNQTAWLMMDENAPLTRPTNTIDVWRPADDTHFKPLDNLAMVPAYDHLVKLDFRFCLDANGYPRACLNGKPFISQKVPSLYTAATVGGNNTNPLVYGQINPVVVRKGDIVQLVINNQEAAGHPFHLHGHSFQILDRARPYAGDWPGRDVNYNPVPNRRDTVTVWSWSHAVLRFRADNPGVWLFHCHIEWHVEMGLTASFIEGPEQLRGKQFPADHLENCRVGGVPTRGNAAGNELDPLDTTGMLTISPTGYTGATWIPPPANTVSMTPGNSTSPLARRRAASRVQRRDTVFENS

SEQ ID NO: 23274 - protein, 1266 aa, Neurospora crassa
MRIAIREQLAALVIFAVLLSLAIVSIPVWIFVNNFVIGVKTDGLALSASLKASRISSEIDLIQTACTTISTRLLLQQAFEDFYTNEYYGNQTADVWEQALEDLASALSTSNVSGLLQARLYSRNTTGDPRGLLNITGQDALDDPVYLPYRSPTGADIKLGDPDYGFPPMLYPNITYENKNLPSPYKANTVQFSANIFPGVSLSNGSEGNGILLGPLVVNESYALVSITVPVRENQSSRFILGYMTVIASARQLVQVQRSNEGLGETGVALFIGPVNPWNHFNSKMPASNQTWSPPRDEFARTNQVHFLLPPAPQPGQEDRHSDHSFESGAYDAPFDPATYQAVLDLFVEKNNQTNNATSKISTKNEQGKKVAIGAARPQTSLVTWAVIVEQDKREATEPIRTLRNILLGCVFGTAGLVLLLTIPCAHLSVMPIRRLKEATEKSIAPPGYEDLSDSDYDEENPSSGGTTSGRSEKSWLKSLKRRMRKSKRARLRAAAAQDAHRHAFKIPAKVEDRKHYITDELTELTQTFNEMSDELLKQYTSLDEKVAERTRELEISKKAAEAANESKTLFIANISHELKTPLNGIMGMCAVLMEEDDVLRIKQSLKTIYKSGDLLLHLLEDLLSFSKNQIGQQVSLEEREFRLGEIRSQMLAIFDKQIRENKITFTVSFVGTDILESSPERRSGIDKRLPALGPPGVGRLKDMCLWGDQHRILQVIINLVSNSLKFTPAGGRVELRIRCVGEMEQTHNQSRSSSLSKNSHRPGRSRHRLGSGSRDSQSSKGAPHSPNLNQSSGTALSINPMDPKSPHVHIRERSPTPPPPNAKTFMFEFEVEDTGPGIAEHMQQKIFEPFVQGDLGLSKKFGGTGLGLSICSQLATIMGGTIGLKSTVGVGTTFTMRIPLKYVRDRASSTASSSLASRPPSAGSLDGETIRNPLPKQSTIDIHRSHSHGHSHSHNHGHDQHSTAPPAAASVLDTQPRLVGLSQPFFATTPTTSGDVDDKMAAIDRAMAAKQLQQSSSGPGKLRVLVADDNSTNVEVVSRLLKLEEVYDVTIAKDGQEAYDLVKANMEHNLQFDVIFMDIQMPNLDGLQSTRLIRQMGYSAPIVALTAFSEESNVKECMESGMDEFLSKPIRRPALKQVLKKFATIYEEQGETETVPSVTTGSMKGEKKDEKVEKKDKKEGREWKGMKDGKGDGSLVNGTITPKTASSTTVAATMTNGSAMTGPTTMMNGAPMRPKPVDVYSDEPSPKTMSKSDGAAKGDYLKRGR

SEQ ID NO: 23275 - protein, 531 aa, Neurospora crassa
MSGATPSRSADLLKPRPDETASLVRKPPSLQSSSTQVEESEVPNLPEYKLWLSELWLLTKNAIPVIFAYTLQNSLQTGSILIVGRLSPEALATAAFSYMFAMSTAWLIALGGSTALDTLASSSYTGSSNKHDLGILLQRGLAVLSALYAVMALIWTFSEPLFRVLGQEEYICVQSAMFLRRLIPGGLGYIWFECMKKFLQAQEVYRPGTYVLLITSPLNALLNYFLIHKLGLGLHGAPLATGISYWCSFFLLVAYATFVRGHECWGGLSPHRALSNIGPFIRLALLGIIHVGTEWWAFEIVALAAGQLGTIALAAQSVIMTADQIINTIPFGLGVAASSRVGNLLGARKVKEASRASHCAVVLSIVAGALILTVLMSVKDVFGRLFNDDERVIRLVADVMPFVALFQIADGLNGSCGGVLRGTGRQWVGAAVNLVSYYGGALPTGIYLAFHGWGLRGLWIGQCVALYLVGVLEWLIVGMSNWEDEVKRAISRLDDGGFGDSSAHVYAYGAIGEGQADEALGERHREGREPV

SEQ ID NO: 23276 - protein, 214 aa, Neurospora crassa
MPLVALGVADLFNFVDYSKTSLAISAAAIAFNPTFWNIVARREYRTKFLTRAFGGNAQVACYFLAVTIFGLGLVRDFLYERALRDQPSHPLLEGTYVKYAAYALLALGNLLVITSTMRLGITGTFLGDYFGILMDGIVTGFPFNVTSAPMYYGSTMSFLGTALLYGKPAGLLLTAWVLFVYIIAIQFENPFTAEIYAKRDRERAKAAGTSKKEL

SEQ ID NO: 23277 - protein, 876 aa, Neurospora crassa
MATTLSSGAAAELPIRSQSVRTRRPPTTSRPEPPLPRSESTNRAEASRPHRRSSQRSASGATTAATTTTTTSTATSSRHHPHPSQQQQQYHHQQQPDMSAAAAAAAAPHGHASAGDDHRNGADAGVSTHRSATGTTKQRYRTVIPAPSGNYAFIKTIGQGSMGKVKLAKKEGTNELASQPIKCDISLIIERVSPDDGRQSREEREKADAAREDRNAREAAIVSLLNHQYICGLRDNLRTRWHWYMLFEYVNGGQMLDYIISHGKLKEKQARKFARQIASAVDYCHRNSIVHRDLKIENILISKTGDIKIIDFGLSNLFSPEEDRKLKTYCGSLYFAAPELLQARPYTGPEVDVWSFGVVLFVLVCGKVPFDDQYMPALHQKIKKGAVDYPNWLSSECKHLISRMLVTDPKQRATMQEVMNHPWMLKGYNGPPDNYLPRREPLTLPLDPEVISQMTGFKFGPPEYITAELTKRIKSPKYQAAVRRLEKERERPEPIAKDAEKKRGFGFDFYKRRNSVTSKDTLTAASSEGLSLGDDPLNAFDPLISIYYLVREKLERERNHVYIDLQQPSKAQQPPPSSSQTVMPVPPSPVIRPKEKHSLADIVPPQPVHNAEPRSRQRTRSHSEDQPREPIQGGLLSPDMVPAKKESTAAGILRRLSTRDRRKEPPATASSTDGKPPLRGSMSMRAKSLGHARRESIQMRRAKREAEAAAAQQAQSQTTEPQRSYQSHHHSVREETDAELVDSDIRGETSGGSNERLEPEDPDLVKPVFLKGIFSVSTTSTKPLSEIRADIKRVLRVLGVEFNEIKGGFSCRHTPSINHAERQPTVMTEGGNEIEFEILIVKVPIVSLHGVQFKRLAGNTWQYKALAEQIVRELRL

SEQ ID NO: 23278 - protein, 350 aa, Neurospora crassa
MSTFTTNGAGAENDGEKVNTHIVTLTRFLTEEQVKHKEATGDFTLLCHALQFSFKSIAYYIRRATLVNLTGLAGSSNTTGDEQKKLDVISNDLFIEAMRSSGKCALLVSEEEEHVIYFKDAKNARYAVACDPIDGSSNLDAGVSVGTIFAIHKLAEDSTGTKEDILKPGTELVAAGFTMYGASAQLVITMKGGSVNGFTLDQGVGEFILTHPNMTIPRKRSIYSVNEGNSLYWEDDVKAYFNSLKETQEDSGKPYSARYIGSMVADAYRTLLYGGMFAYPADKKSPKGKLRILYECAPMAMIFENAGGQAVDSKMNRMLEVVPEHIHDKAGIFMGSYDEVEKVKKYHGKA

SEQ ID NO: 23279 - protein, 1536 aa, Neurospora crassa
METGMDHTQDTTPTAEGHGQLGNSYQTPDQLAANNIKVQDYIDNTALATDLHANDASNSSATADGGSSAITSPTNLSSWSASSDRQLGHGSVQDPEDRVFPIRSVISVDLAATPPVNDDIRARRRISLSEGYATSAGAGNTATPTRPHASTVPTAKSGAIDVESRPTVSQSQSSVSQPDGSSVFSSSSAGTMRHKRRMNAMTGSLSSVQADADRYGKGRPIELVLGDSSEEESDGGADGSGDGGDLGTIGASSSSGRESLDALPETHFAPRFKHIVTNEGHAVITGRDGQLQRCEDEPIHTPGAVQGFGLMVVIQEERDGRFIVRFVSENSKRIIGYTPQELFRMNNFLDIFTDEQSENLLDHIDFIRDEDSDPAINGPEVFSLSIRLPKAKTSVRLWCAIHVHPSRPELTICEFELDDDHDYPLRPPEEDLPDIPEDTLQSNPTTEELTESTAISSKPLRVLRSARRRRGEAGAMQVFDIMSQVQEQLANAPNLEKFLKILVGIVKELTGFHRVMIYQFDSSFNGKVVTELVDPMQTRDLYKGLHFPATDIPSQARELYKLNKVRLLYDRDVESARIVCRTPEDLETPLDMTHSYLRAMSPIHLKYLANMAVRSSMSISINAFGDLWGLVSCHSYGPKGMRVSFPIRKMCRLIGDTASRNIERLSYASRLQARKLINTVPTDKNPSGYIIASSDDLLKLFNADFGMLSIREETKILGKIEQSQEALAMLEYLRLRKFSSVVTSQDIKIDFPDLRYPPGFQVIAGLLYVPLSVGGNDFIVLFRKGQVREVKWAGNPHEKTIQAGSAAYLEPRKSFKVWYETVIGKSREWSEEEVETAAVLCLVYGKFIEVWRQKEAALRSSRLTRLLLANSAHEVRTPLNAIINYLEIALEGSLDQETRDNLARSHSASKSLIYVINDLLDLTKTEEGKDLVKDEVFDLLACIREATEPFRHDAKRKGITYEVIEHPGLPRFVHGDQRRVRQAVANVTANAVKHTSEGSVRVELYVAEVQDNRARIDIVVQDSGQGMSNAQLDALFRELEQVDTDIGSESSDDDNSQSGKALGLGLAVVARILRNMDGQLRLKSEVGKGSRFVIQLPFDLPEEETSRDTVGASSGNTAQLSLGSGTASASAASVTQMQDGEVMLVDRNNGSSWSVNNATGSLASKKSYDDNLSITSKGSGRSALSDADRLIDAIQNPLTLGEPEPESVARQRRNSRGPYYNPSSSLLGSSKGRSVSPGSRKRPDVPTRSVSSPNTKKDLPFEKPTTEVAPGPSEPAPAAQGVQYVTDSRVPIKPVKLPDEMFDKPVVPPQSTSKVLFEIKDAVADKAKAASSAVKEQQSVSSQQPAPPPAPAKEASTTNNKLQVLVAEDDPINVKVLRKRLEKAGYKVTHALNGEDCAAVYEDKPVVFDVVLMDMQMPIVDGLTSTKMIRAFEKTNRDGSGQQLSDIASDHGRVPIFAVSASLVEQEKDTYVDAGFDGWILKPIDFKRLETLLQGITDDKARNDALYVQGQWERGGWFEKKGVGNMGQEQEENHEQ

SEQ ID NO: 23280 - protein, 595 aa, Neurospora crassa
MRFLPLLGGLLPLLGLVGAAPSCNHECNRACWTSRFNVNTDYENEWPVTGVTRKFDFEITEVDEWVGPDGHIKKGAMLINGGYPGPLIKADWGDRIEVTVTNKLKTNGTSMHWHGFHQLNSNNQDGVAGVTECLIVPGASKVYSFLATQHGTSWYHSHISSQYANGIVGPIQINGPSSYPYDTDLGVFPISDWYYDSAEHIVDRMMDPNDPFLKGVPGSPPPSNNILFNGMNIAPNGTGGEYARLKFTKNKRHRLRLVNTSADNTFVVSIVGHNMTVIETDFVPVEPYAVHQLYLTVGQRYDVVIKADQEVDNYWINATLSSTPLCGVSLNPYPAAIVSYEGSDESRLPTNRGPRAIDQFCEDDVSSKPLTSRTAPKADFSDTKVDTLSVTLDVKEVNKGISKVLWSVDGSAIDVQWDKPTLEYVVEGNFTFPRQANIIQLPEAVKWSFWVIQNNSPSPHPMHLHGHDFLILGRSRFPANPLVDPGQPILFDPVVDGPHLKFDNPTRRDTTVVPSFGWLVIAFEAGRNPGSWVFHCHIPWHMSQGLSVQFLERVDRINDGAIPNLMPDLQEKCDEWRRYADNDPEFRMKKVDSGI

SEQ ID NO: 23281 - protein, 474 aa, Neurospora crassa
MDNIDKQHLGAAGVSFPAGLDDFRAARDRCAHACRRFNSMPEDATPDVRTSLFLDIIRPARNRKEDGAITHDMTFRDPTLKALTPFVKPPFFVDYGLRLRVGGSTFINRGCFIMDTPVADVTIGENCNIGPHCTLVSVGHPIHPEARESQRSSIGKPITIGNGVWIGANVTILGGVTIGDGAVIGAGSVVTKSVPPLHLAIGVPARFRPLAEVPRKLDAGSTVDSLKEALACGRSSLSSSPLSSQQQQQQQQPSFNTTAGSYHHHYQQQQQQQQQQQQQQQNRLLTQSQAEELDRLAKLCVNPALMRAATNESHYHFSSHQSMLTELRYTAGAQQLKLRKTETISPSDMPRVDMTQFAAWQSHSSSSSQQCSSSSSSNGVGGSSKEAGGGSSSSVHGGAGRERRVSRIVRAELTAIATVTVVALLLIVGIFFAGVLLGAKRITIVVDAVAPEELRKFGGGGGGGVGGVNLVRGL

SEQ ID NO: 23282 - protein, 769 aa, Neurospora crassa
MPPATMMMGAYGQQPSGSDGIDSTINKIMTNLQEGLDMSSYMGIYTAVHNFCTSQKANGGSSSPSNHLPGIGAQRGAHLLGEDLYKKLANYLTDHLKHLVSEAEAHKDEALLAFYIREWQRYTNAAKYIHHLFKYLNRHWVKREMDEGKKNIYDVYTLHLVQWRDVLFQAVSKKVMDAVLKLVERQRLGETIEYTQIKQVVDSFVSLGMDEGDNTKTTLEVYRYHFERPFLEATKVFYQNESKQFVAENSVVEYMKKAEARLAEEEERVRMYLHPDIALHLKRTCNQALIAEHSTLLREEFQALLDNNREDDMRRMYSLLSRIPDGLEPLRTRFEAHVRKAGLAAVAKVAADADKLEPKVYVDALLEIHTQYQGLVERAFNKEPDFTRSLDNACKEFVNRNEVCKSGSNKSPELLAKYTDVLLRKSSTGVEEAELENTLTQIMTVFKYIQDKDVFQKFYSRMLARRLVHSNSNSDDAETSMISKLKEACGFEYTNKLQRMFQDMQISKDLNTGFKEHVASLNMDGKPLDSTYSILGTGFWPLVPPNTSFVAPAEISADCDRFTRFYKNKHEGRKLTWLWQLCKGDIKANYMKGAKMPYIFSVSAYQMAILLLFNEKDQYTFEELASITQLNADVLEGALGILVKAKVLTAEGGEGGKIGPGATFSLNYDFKNKKYRINLNVGMKSETKQEEAETNKTIEEDRKLLLQSAIVRIMKARKKMKHQQLVSETINQIKARFMPKIGDIKKCIEILLDKEYLERLEDDELGYLA

SEQ ID NO: 23283 - protein, 356 aa, Neurospora crassa
MGACMSKNDEETEQKKRSQKIDRDLEEDSKKLRKECKILLLGSGESGKSTIVKQMKIIHLKGYSDEELTNYRPTVYKNLLECAKAVVNAMHQFDIQPADPSLRPYVEFLQDYNMEGCPPGQSIDPKVGTAIQALWNDPAKEQLMERQTEFYLMDSAEYFFTEVMRIVAEDYRPNEMDVLRARTKTTGIYETRFKMGQLSIHMFDVGGQRSERKKWIHCFENVTSIIFCVALSEYDQVLLEESSQNRMMESLLLFDSVVNSRWFMRTSIILFLNKVDIFKQKLGRSPLGNYFPDYSGGNDVNKAAKYLLWRFNQVNRAHLNLYPHLTQATDTSNIRLVFAAVKETILNNALKDSGIL

SEQ ID NO: 23284 - protein, 574 aa, Neurospora crassa
MASPGFPPRHLDATTGREVVYCYGCENEWYRDDYPHLDLECPRCHNDFVQIVEPDNDPRPGVQQQGHRSDSDPEEDDIEQFLERGPGSFFMRRSVYQSPDSPFNRSSGNGLEDLDSSPDRPRARPDDPGEAVLSRFADMFVELSGARPGQQGGNAFGTQPRIQRTTFTRAGDGMASFTFTTTTTAGGPAGDGPEAPAFDTLFRGLFGNIPPPGAEDPGGGQGQGQGGGPRGPPLGFATGLQDFIATLLNPQAAVHGDAVYTQEALDRIITTLMEANPQSNAAPPATQAAIEKLPKKILDEQMVGPEGKAECTICIDDMYKGEEVTVLPCKHWFHGECVTLWLKEHNTCPICRMPIEGNNPSGSNSNNNNNNNSQPSASRQEASTNSASAFASSSAPGRNPFESLNPFGSQAQSARERLRRSEQEREERLERIRNVAGIRRTDSQSEGISRRTSHSPPSRENSRFDMRSRDRDPSPPRDRGTSTAWQPNPSSNSQSNISSRYSGGLNNLWGRNNGNNGEGNSRDRDGQQQQNQQQQQQQQSSSSGNGALGWLRDHFGRGSSGSGSGADRDRERRR

SEQ ID NO: 23285 - protein, 2313 aa, Neurospora crassa
MADPTQNQQTDTADPVVAPVAKEDAETTAARRELKHTSISEQSAAAAQDSGSDNGTPTAGSRKATPEPAIGDDKDTEMKEQVSSPKKKRAHDELEESKDAIDAQSGDQPSTEEAKPTATQSRTDRSEPEKKRARDETSASDDGVKETTSSASVATTTTEIPSKPAEPAAEIKPTSEEKPQTSSAAFAQSGFAKLASSTTSPFGALGASAAPSLFGSTNSGSASPFGTLGASTTAAAPTPPKLSFGSSAAAPSPFAGFNSASSGSVFGGGFSSGFGGSALGGAKLTSFGGKPGETLMSSKPAKPFGAPESDAEESEEEGGNEKEDAGANEDKEGENDEARTAAEEEKKLKLRKVVVDDGEGEDATLLAVRAKIFVMEKGVGWKERGAGMLKVNVPKASVKRDHNGNWDATSFDASALVEDSGDGEAGSGGGRKSVRLVMRQDHTLRVILNTAIVPAMTFAVTKKLKAAYVLFTAFEGTEPRQVQVKLSEANATAFKDLMDLIQKELSDDFATAFLNYNGWYQNAKVSSILSRTRRHGCADADFGLHQAARAESFMMLMSKEQLDSLTNDLCRYAMNGDEWAVACTQASLLQKSLSLFGLRSQFITPPILRSLLFRLRHALTSSTILTSSHSDYTIGWVCALAHESAAATAMLDVEHSPLTQRPNDTNSYTLGSIAKHNIVITCLPMGEIGTTAATTVVERMLSTFPSIRFGLMVGVGGGMPPKVRLGDVVVSVPSNHYPGVVQWDMGKTIQGSKEEDESFERTGSLNRPPHILLTAVNNLKAQHERRPSRIPEFLKQLESNSPMMASRYLRSEALKDVLFQSQYLHHTCSDESRLDPRLLLLKVFSILKFILQLFVLGSWKHNIPQPQSLPHTQHAQPGPDDSDKLCALGLESDALDDEEDDGDCRFCDSTKVIERKPPARKMRIHYGLIVSGNQVIKNALSRDKLNAEFGGHVLCIEMEAAGLMNNFPCLVIRGTCDYADSHKNKRWQRHAAAVAAAYAKELLHVVRPVDVNGERAAFDIIKEVKQKVVETAENVNYLKRGLQRREDLDVLDWLTPINFGSQHSLSRDKQQRGTGTWFLNSAKYQTWRDEDRKVLFCEGIPGAGKTILSSIVIEDVTNITHSLAGEIEAAYIYCDYRRQGEQTALTLLSSLTKQLCLSKESLSPGVGALHAKHTSKSTRPSLQEVTQALKDVIKHFTRVYVIVDALDELLDDEDHRTAFVDGLRNLGQSSPNLKLFVTSRPLLTDISQFFDDAAKVEVSANQDDLRRYVDGRFSKMPVSSPLRANEVLQQEVKDTISQAARGMFLLAQLYMDSLRDKSTPKEVRDVLQGMQHQNNASKKFSVEERLYKAYDETMARIDKQELGFRDRATQILLWITHAERPLSTDELRHALAVEIGSNELDEDNLVARLDVSICAGLAIVDYKTQEVRLVHYTTQEYLEQRHFKLSWSINPHNTITEVCVTYLMYSIFKSGPCTLHDQYLERISKYSLYLYAAKYWVEHARLSSEASKFLPDFLQCKEAMRAAAQADYIGLKKFIWTFESWETRESKYAPRSAFHLAVKYGLHKAAEALPERSEDLDALYERKTPLYMALRNGDMTMARTLLRKGAQVRVLGGTPVLEAFTGEIYRKFECDVSMVEDLLNNGAEIANSVGDCPLLFAAAGSGHEQLVALLLQRGANPETLGELYWTSGKVTSLFTATHEGHLGTAMILWKSGADPNRSFPEYNLSALHRAVENGHEQLVEMFLGTENGMQLSISGDSPVDISRVESLDYGLKAESIDLAKECNSISAQIAVDIESQDVNGHTPLALAAKLGYCCVAGILLRRGANIEGRAKENEFPSQESWIRNEYYGNRRQETPLLLATRKQRSDMVKLLLEKGADIEARNYRGETPLLVAVDKEQSEMVKLFLEKGANIEAADEDGWTPLLAAAYRGNAHLVELLLQNGADIEAAAPDRYTPLLMAAEEGNSLVFELLLQNGANIEATNSNGCTPLFAAIYTSDAHLVELLVDKGADTFAINGDGHTTLMMAAANGDSRLAELFLQKGVKINAVNERRETALFCAVVNGRASLVKFLLNNGATIEPQDKHGLLKPLAWAEFLGHTDVVRVLVEECPNIRNREDDGETLLCLAVRGAEEYWVDRLLEKGAQTEERNGRDQIPLEVALDMNNKDTVDALCYADADIESTDSQGRKHLVHAISKGLVECLKVLLLYGAKTDTGTFNSQTLFEMAYEGGSQAHRKVYRVLMEHGGFTLDTIPAGHSDWLRYDEEGALSVYEAIDESLIDNVSRADLAGEDLDGVAPILDPLQYLPVWVDLIRAII

SEQ ID NO: 23286 - protein, 549 aa, Neurospora crassa
MGVVGRAIVEVSSKLTGVVANLVQEETNGRGVIAPDGYQRDVLLVNGAFPGPLIEANWGDMIVVNVFNNISSPEEGTAMHWHGFLQDDTPWDDGAPGVSQCPIVPGKSYTYEFNASLYGTSWYHAHYSAQYAGGIVGPIVVHGPTQAKYDIDLGPVMLSDWYHRPYFDLIKDMLAPGGSPSVPSDNNLINGKMNFDCDTAAAAGDQTPCTPNAGISKFKFQTGKTHRLRLINSGADGVQRFSIDGHTMTVIANDFVPVKPYNVTAISLAVGQRADVLVTANAAGSDPKSAFWMRSDLAKCSAAKQPFALAAVYYDQADPETAPSSQPWADAGDPDSTCGASDDLGKREPLYPIPVRGEPAVTKEMKIEAYRNASDVFLFLFDGVSARVDYNHPALDMVMKGNMSFPEVSNVKDFGSAKTVRVVVINKGPGPHPMHLHGYNFYVLSSGPGDWDGKTIVRSSNPVRRDTEVVRPHGHLVLQFDANNPGIWAFHCHIGWHASGGFVASFLTQPDEVRRRWGGDRMPGKMEQVCREWDAWSQNTVVDQIDSGT

SEQ ID NO: 23287 - protein, 423 aa, Neurospora crassa
MANNTITPSSSEPEMTQIKSYGATTLVTAEQTTSNTSGAAPNNNAVLTGLDEPDLVALGIQKLEAQNVHWYSYLLTVDFWLVILIGQILSLCITATNTFSSFLSELGTSIPAIQTIFVYALIFLVYFPIALYKTGGPRKFFEQTWRNSWKYIILSFLDVEGNYFTVLAYRYTNLLSAQLLNFWSIVCVVIISFALLKVRYKWFQIGGILICCGGMGILLASDHITGSNGGPGVNMLKGDLFGLLGATLYGISNVYEEWFVSKRPVYEVLSFLGFFGVIINGVQAAIFDRQAATDATWNGPVAGYLVGYTFAMLIFYSLAPLILRMGSAAFFDISLLTANFWGVIVGVKVFHYVIHFMYPIAFVCIILGLVVYFLAGSVLGDSKKPWLGADQSEGVAGVGTAKLKALNAARQKALADGEAGARV

SEQ ID NO: 23288 - protein, 134 aa, Neurospora crassa
MASDPMSVNSSAREPPAPPGSGADEPKYGGYTRFELELEFVQALGNPLYLNHLASRKLLSNPAFIAYLDYLQYWSRPPYLKYITYPGPTLKNLELLQQEKFRQDIISPDLVERLRLEGMKAGIDWHRESFPSTA

SEQ ID NO: 23289 - protein, 565 aa, Neurospora crassa
MDSSHQPSVDEKRSVRAGGRPEDRDEIVAAVENGVVVNASGYRDQLDRQYSLLGLAGIAITIDNAWIALGSSISVSIPSLGLDWLSLHQLFQLLVVFTIGPLSARLTSLPAGGPKYGRILGFFTGWINFYGWMFDLAALMQITANICISMYSVYHQTTYTYEPWQVYITYLLVLWLSTAVVIFANRVIPHTQKIGMFFVIVGGIITIIVISAMPKRHASDYFVWKSFTENNLTGWPGGLAFLLGVLNGAFTVGTPDAITHMAEELPHPKKDLPKAIGLQIGLGFLYAFCFAIALCYAITDLDALQGGFNTYPLANIYAQATAHADGTTNHGATFGLLFIILCSSLLCCVGTVLANSRIYWALARDNAVPLSPLFSRVNETLSCPIPATLFVALGAIPLGSPTAFLNLTGSFIILTTTSYAIPFAANILTRRRYLPSAPGSFRLGKFGTPINILAVLFIVLFNALFCFPYDYPTTTESMNYNSVILVGVVALTALWWVVHARRNYPGPRVMALYIHGGDITGERVQVSEGVEAPGSGLEQEGYGGVGVFREKPQEKKKGSDGGILP

SEQ ID NO: 23290 - protein, 604 aa, Neurospora crassa
MSLSRHVDPEEIIHHLKDIKLQEKGSGSQRQNHLTPYNSSYASQEDIPKYKIPENGTPGDTVYAMLRDELDLDGRPNLNMASFVNTYIEKDAQKLFVENLGKNLSDNDEYPAMISFSDRCVSILAHLWGVQKGEKAIGTATVGSSEAVHLGGLAMKRRWQEKRRAEGKDAYKPNIIMGANAQVALEKFARYFDVEARILPVSAQSNYCLDPALVKENLDENTIGVFVILGSTYTGHYEPVEEIHKILDDFESQTGIDIPIHVDAASGGFVAPFTYAKTGGHKWNFELPRVKSINVSGHKYGLVTPGVGWIVWRDESFLPKHLIFELHYLGGTEYSYTLNFSRPGAQVIVQYYNLIHLGFQGYRAVVENCLSNARLLSKALEATGWYTCVSDIHRPPQKQAGSVKSGSSGYDGENDQSCCSESQNDDQKAESEESKTHASSSSLSSSKDTPETDRNREETSADYTPGLPVVSFRFTDEFQQEYPHVKQETVSLLMRARQWIIPNYALPPNEDQTEILRVVIRESFSFDLIDRLVTDLVSVTETLMENDEVDLSLLQQHQGGRRRPLTKDEKRIEKEEREREERKGEERGEEKGKRMGEGIHRSVC

SEQ ID NO: 23291 - protein, 666 aa, Neurospora crassa
MASPPIPIQSSGRRRGSAARRESRDFHDTIFDTVSLLGTSYLSTAPIAQEILARDLAELEDDEQHERDEECRSDDEEDVEPPIDVGSLPVGHLVSRPGGVAYGTLRPIIASEMQGSPIVCETDVVESRAAERSLLRDNHLLPPKHPRSPDDPLWKKMYRRLFSTKVPVSDKAFEETPLLQEYPLPPSPTISEEINQWERAVAQNMLKTTWQREAQTITKYSRSLIVTFLLHYSVTVTSVFTVGRIGRLELGAVSLATMTANITCYAPVQGLSTCLDTLCAQAFGSGHKKLVGLQLQRMTYLLWLLLLPIATLWWFSGGVLHRIIPDPDTAALAGMYLRVLILGTPGVAAFESGKRFVQAQGLFHATTFVLLIGAPLNVLANWFFVWRMGWGFTGAASAVVFTQNLLPFLLFLYVRFIQGMECWNGLSRHAFSNWGPMIRLALPGMIMVEAQYFAFEVLTLAASQFGSAHLAAQSVLVTVTSTTFNIPFPLSIAASTRVANLIGAKLSDAARTSAKVALCCGIVVGLFNMTLLSSLRFKIPYLFTKDEEVAAIVSKVLPICAVLQLVDALAAISHGLLRGIGRQGIGGFTNLFSYYLIALPISFSTGWALGWQLQGLWFGVAIGLAVVSTVELWYLHQADWEHAVQEAENRLRSDEACHQSQRRESK

SEQ ID NO: 23292 - protein, 537 aa, Neurospora crassa
MSFSPPNKSADATIQITEMTRQGTPSSGEAAASTPSTSSTESGDKALEALGYTPVFKREFSRWSSFSFAMSISGVYGTLMSTWIYGLQAGGAAAIMWSWIIGGAGGWALAYSIAEIASAYPSSGAMYFTLKFLAPEEQVPFLCYLNLVGTVAGGASTEYAASQMLLAAVSITSNFSYVPTPTHVVGVMIGLTTIHAMINTLPTAWLNRLTSGYVVFHISVLLGACVTLLVQKRHDMHDLKYAFTNFQPSSGWSPPGFAFLFGCLTPAWIMTGCDGTARIAEEAKNPQMVVPRAIANATTFTYVIGFFFNLVLVVCMGDPKDLINSPSGQPVAQLFFNGMGRAPAIFFTLCGFGVMNLVAIPGIQAGSRTIFALSRDNLLPFSHIWVRISKRSQTPLIAVWTYAVLEIIINLLGLASSTAIGAVFNVCTVALNVSYVIPIICKMVYGRMQKGPWHMGKYSVWVNAFAVAWNTFMAVIFFFPTRLPVTPENMNYAIVVFFFVLIFALVFWYTHGRHYYTGPLTHSPRATDMSVRTPVGV

SEQ ID NO: 23293 - protein, 930 aa, Neurospora crassa
MNWILEAGDGDPGGCKGEDYVRPGNKDTWYQFIISVSLGISAFLAFCALRPRWKSLYASRKRASMADPSIALPQLPDTFFGWMGTLYRVTERQVLASAGLDAYVFLNFFKMAMKLFVIIFFFALAVLEPINRAFPDDLNTSEVPPTQVFRQYTYPYGHTTLYDDDPDQPDDSFKKSKRYLWSYLVFTYFFTGLTLFLMNRETFKVLRVRQDYLGTQSTITDRTFRLSGIPKDLRTEKDIKNLVEKLEIGKVENVTLCRKWKELDDLMDKRQAILAKLEETWIAYLGQKPVQLARGPPPNTTADGDLENGRLIPDLGNEEVGETGRLLGNTTSDLISSERPRPQTRIWYGFLRLQSRKTDAIDYYTEKLRVLDDQIRAARKKHYEPTDLAFVTMDSIAACQMAIQALIDPHPGQLLTKPAPAPSDIEWRNTYASRLTRRVRSVAVTLFVAFLTVVWLVPVAFLASFLSICTIEAYFKGFAMWLKQYDLARALVQTGLPTAVVSLLNVAVPYFYDYLSYQQGMLSRGDAALSTISKNFFFTFFNIFLIFTVFGAVTSIIDVLRESLKDTTYIAYVLASKIENLGVFYTNFIMLQGIGLFPFRLLQFGSVSLYPINRLGAKTPRDFAQIVSPPMFYYGFYLPTALLVFILCLVYSALPQGYKVVGLGVAYFTLGYFTYKYQLLYAMEQPAHATGGAWNMICYRIMLGLLVFQLTMSGYLALRKAFTAALLVSPLLIITVWYGYSFRRHFEPLTKFIALRSIKRGEDIGENAILDEDLDGEGAETRERIRRGSTLDEDKEKGAKFVNPNLVKPLEQPWIFKDAPPLLYPSSSLSDVEDRYTDEEPNSGGGSDLYAGSRRPTRNANGLRVETSRGSSQSRADSGGGYADLLGADMYTGLGRGGERTPRTPAADTPRSNASSAASLGDTHIWRDGF

SEQ ID NO: 23294 - protein, 361 aa, Neurospora crassa
MATPIPVQILDGGMGTTLEDMHDITFSFETPLWSSHLLVSGEEDKLSDCHEAFKQAGANIISTATYQISINGFAATKAPRSGTVDEEREGIEKEEIPRFLSRAVVLAANAAGTEGKVALSLGPYGATMIPSTEYSGRYDPEHQHVQALGKWHKERLDLFKDVDPNQVNYIAFETVPRLDEIVAIRNLLSADNIPTSLRGRPVWISSPYPNDDGKLPDGSTVEEVVKAVLTHREGLETPWGIGINCTKVEKLDSLVKRYEDAIQTCIKNGEQMAWPSLVLYPDGTKGEVYNTATKTWELSPGHKETEAPWETVLASVVEAARQRGNWKSIVVGGCCKASPEHIRRLRRTLQDYGHMSTSPAA

SEQ ID NO: 23295 - protein, 435 aa, Neurospora crassa
MTAQTTAMEALQKELDRLNRAPGLSATEDRVDNIIEMLTSVKDQIVQSGVTATQRKLGKTLDKHFPLKDLPSTHDAMADQESLINRAISMHLLREGQFSVASTFIEETGDAATLENANAVVEGQDQVSASDNYDDEPMDEDRDDDDDDDDDEDDDDDEYMSPLEGAATGLGFRQLQNLSSLQSHELEAKFSQMYTILQDIKSRNLLSAIEWARSNSGELEARGSNLEFELSRLQYVWLFKGPRVNGLPDNELNGTAGALLYAQQNFWRFGNRYIGEIQQLANAQIYARNLSESPYRHTFSTETAFADVASSFTREFCSLLGLSAESPLYVAVTAGALALPLLMKYQQATRAKGTEWTTTNELAFETPLPERMLYHSIFVCPVSKEQTTEQNPPMMIPCGHVLAKETLQRLLKGTRFKCPYCPAEGLEKDARRIMI

SEQ ID NO: 23296 - protein, 1168 aa, Neurospora crassa
MSTAFQTTPNQSISVSATTSPSNRQYSSFHPGPTTREGPGSGYYANQHNAGQSSPHTSSQPHSRRPSAYDQPTGLEPHMSARTAFAQSIPAPVTSIASDQPPSSSDRRRNNMPTAVPPRTSSRHDPNTSSRRAQQAADRAAASRQSNTNGTMDPAVVDEAAARSRRQHQMTQDAHQRTTSSRGNPTPTSLPVRSQPNATSSRQQSSREASEILNNILIQQPEIDIERERERLAQAQAQAHAQAQAQAQAQAQAQAQQASNYNHHHRQETASQAMAAPGGDHGEESRRGHRSRHDHSKREKHTKFGEYILGNTIGEGEFGKVKLGWKQEGGVQVAIKLIKKDTVGNNPSRMAKIMREVAILKQLTHPNIVRLHKMEESDRHYGIVLEYASGGELFDYILNHRYLKDNAARRLFAQLVSGVGYLHKKGIVHRDLKLENLLLDRNRNIIITDFGFANTFDPNQELSEEEELNLSDREFVKRMGLDKVNDAGWRKGDLMQTSCGSPCYAAPELVVSDSLYTGRKVDVWSCGVILYAMLAGYLPFDDDPANPEGDNINLLYKYIVNTPLTFPEYVTPHARDLLRRILVPNPRKRADLFEVARHSWLSEYSHVVEFITSSTTTPSEIQNTTVPAEDEGESPHLARSASVREAPKKSTASPAIGGLVSKQGTVDPEAEAAYAKQQRDNKRRTVQVEYVAPNTTTQRGDIAGQQQPSSNANRNRNESQAPVESSDSRPTTSAKDKQLSQGPSAPKDAYNNKPPVSSRRPPSSQRNGGNAPTTGNAVAPPRPSRDGRPTADNQYLSGAAGAPTQRPTTGGSMQSGRPSYAQPAPPEVADANVHGRIQQPSKGSGSSHFGVPTTTPAEQQPSESADYGRPSISTGSRFDKVREDGVVKGHKRSSTMGEIGGKLFGRSGSLFGGRKSKRQQELQQAGEKTKRYPPVSMNNSMPGGENGSRPSLDSKRSRRSFSMGMGKKSSGGSITGSNGSQEKSNKRFSFIPPSLSRAFGYNKEDEPPALDSQQDLPIQEPSSVDQFLGREQNVSATTVDGMYTQLQDSQQGSPAVNTQYQYGRPSASQGFMPGTMPNAGSDPSVNSMPQAPGSTPQLQTMTQQDGLYDARKGNSRANRGVLQKNKRFVDYEGDGFARPHDHSGSSGPARKVMDFFRRRGKARGGENN

SEQ ID NO: 23297 - protein, 663 aa, Neurospora crassa
MPKIKKKGQAGAAKNYITRTQAVKKLQLSLPDFRKLCIWKGIYPREPRNKKKVSKSATASTTFYYTKDIQYLLHEPLLQKFRDQKVLEKKISRALGRGDVSDAARFERHAARPEATGKPRYTLNHVIRERYPTFNDALRDLDDCLSMLFLFANLPSTSAVPAKMIARCERLCLEFQHYLIVSHSLRKSFLSIKGIYYQANIQGEDILWLVPYKFNQRIVGDVDFRIMGTFVEFYMTLLGFVNYRLYSSIGLKYPPKFDQLKDENGAELGAFSLEGVNMATQGETKAVTNGEEQQQGPDPKVQAEVDKIIKQLKEDESKSDETAEEDAEADDEEKPTDSIDKFEPVAPGGDVLPQPAYSSSDPSQLFANFTFYLSRETPRQPLEFILRAFGCKRIGWDSVLGEGAFTNDESDPSITHHIIDRPVVQAATNEDGDGEDNQTAQKVGPNQRYPGRIYVQPQWVWDCVNDEELKSPELYAPGAALPPHLSPFVKAAPGQYDPTLPLEAQQTEAEAIEADLEDAEKGNAEDGSDVENDMDVDEAEDDEEEEEGDEEDAEEAEEEDAEEDEEESKTLQRQLELEAELQGKKVQNTKVDSKTKAKLEQRKALEKKAREEAEDLERAKGMLSKKKRKLFEQMQYTNNKKSAQDEKLRAKRRKLEKEKAQKA

SEQ ID NO: 23298 - protein, 259 aa, Neurospora crassa
MAQVPVQTIHRDPQLFYWILFPITIVMILTGVLRHYASVLMQSAPKKLDQKAIREQRSLLHGINLRGNFHALSKKSFATRRDALVTAFESGAYLKDPERAGQGQPNPLSDPSSMEGMMGMMKNQMAMIIPNTLIMSWINAFFSGYVIMKLPFPLTIKFKSMLQAGVMTKDMDPRWMSSISWYFLCIFGLQSVFNFLLGSDNAASQMAQQMGGMGAAPQMFGPGVDPDKQFKAEAENLAVIEHYSVLDNVEERLLEGITV

SEQ ID NO: 23299 - protein, 143 aa, Neurospora crassa
MAGGKGKSSGGKSSGGKTSGVEGPKKQQSHSARAGLQFPCGRVKRFLKQNTQNKMRVGAKAAVYVTAVLEYLTAEVLELAGNAAKDLKVKRITPRHLQLAIRGDEELDTLIRATIAFGGVLPHINRALLLKVEQKKKAKAQEA

SEQ ID NO: 23300 - protein, 333 aa, Neurospora crassa
MSSSSGVPESWIASFCSLLGHEYFAEVSEEFIEDDFNLTGLQTQVAMYKEALEMILDVEPEDDDDEEEEDEEDEEDMSGGDGINKPHGERRHHSRIASDLSVIESSAEMLYGLIHQRFICSRAGIQQMSEKYELGHFGICPRTNCNQTRTLPVGLSDTPGEDTVKLFCPSCLDVYVPPNSRFQTVDGAFFGRTFGALFLMTFPEYDLTKTGAESVSNLTRSGSDDTTVINGMYARNIAPGLGRGKIYQPKIYGFKVSEIARSGPRMQWLRSKPDDLSVLDEARRYAEQQGSDDEDESMGVSSRTASRRRGPPRRQKQNGSPMAIEQNGAESEL

SEQ ID NO: 23301 - protein, 606 aa, Neurospora crassa
MPGILVATMFMPGVSIIGFLQALTVFSAATASSLVQRDSSCNTPDNRACWTDGFDITTDWEKEVPYTGRTVHYTLVLEQGDIIGPDGVFKHDAMLFNGSFPGPTITADWGDYVNVTIINKLLYNGTSIHWHGLQMEDNNINDGVGGVTECPIPPNATKSYLFLAEQYGTTWYHSHYSAQYGNGVLGAIVFNGPASANYDVDLGTFPINDWYYESADQILAQVQAPGEHGGPTIPPPPDNILFNGTNVNPADITMGEYARVVLTPGLKYRLRLFNPSVNYAYTFSIVGHNFTVIATDLVPVNTTDPSTTVSSLFIAVGQRFDIIIQGKTEEEIASDGGNGNYWINATQPISGYCGNFYGKPAAILSYDFPDATDELPIVDGLVPEDLRCEDSTDFRPVVVRDVPPSEFSISEYNTLPVHLMNDKKQSKVFWTIDNVAINVSWEQPLLEYIREDITFWPYSENVLEIPPESEWSFWLIENKSKIPHPMHLHGHDFVIVGRSPAPDGPGLSDAMMPVRHFDPVLDTSSLNFTNPARRDVTMLPGNGWLIVAFQNENPGAWLFHCHIAFLERKNEIKEKMDLNLLVDNCAAWQSYIDTNPPYQPKNDSGV

SEQ ID NO: 23302 - protein, 2509 aa, Neurospora crassa
MSLTKEQAAATLETYIRDVRNRTSSDDARKRAARQIRDLVNVAKQGKSTNSEFLLRFLSDIGTHANIQGCIEMGAEQFTAFFNTVNQRTMALIQGTDTCDRMGGVYILDALVDFDGIDLALKYSRFEQHIGYILRSKDVTPMQPAAVVLGKLCKPGGSLISELVDAEVKLALEWLQSERVEERRYAAVLILRELARNAPTLMYPYVNFVFEQSWIGLRDQRLLIRATSAETVSACFKIIRERDQAMKQEWMDKMFHEAVRGLKTNTVESVHASLLVLKELLEQGGMYMQTHYGEACDIVFRHKDAKDPAIRKTVVLLIPDLANYAPNDFASTYLHKFMIHLSHMLKKEKERNDAFLAIGNVANSVKSAIAPYLDDVLIYVRDGLSIQSRKRGSVDPVFDCISRLAVAVGQTLSKYMEALLDPIFACELTPKLTQALVDMAFYIPPVKATIQERLLDMLSKVLCGEPFRPLGAPHPNTLTSIPAIPKDPKDPSVQERGKAEVKLALNTLGSFDFSGHVLNEFVRDVAIKYVEDDDPEIREAAALTCCQLYVRDPIVNQTSYHALQVVADVIEKLLTVGVSDPDPGIRRTVLAALDERFDQHLAKAENIRTLFFALHDEQFAIREVAVSIIGRLARYNPAYVIPQLRKTIIQMLTELEYTDVARSKEESSKLLSLLTQHAQDLVKPYVNSITEVLLPKARDPTPSVAATVLQAIGELCTVGGESMLAYKDTLMPIIIDALQDQSAPIKREAALHTLGQLASNAGYVIKPYLEYPQLLEILQSIIRGEPQHGTLRQETIKLMGILGALDPYKHQASPAKDSMASQVANVASARSGNPSNKTPDSLKTALTNLMQVEERTDDNKRNNEAAQLTDVSLMMGGLTPSNEDYYPTVVINALLQILKDQSLVQWHGNVVDAIMSIFITLGLKCVQFLDRVVPAFISVIRASSNARLEFYFNHLSRLVSIVRQHIRVYLKDIIDVLQEYWHTTLALQSTILGLIESISRSLEGEFKIYLAKLLPLMLGVLEKDVSTKRQPSEKVFHAFLVFGSSAEEYMHLIIPVIVRLFDSHSQPLFLRKSAIETIGKLSSMVNLNDYASKIIHPLTRVLASGEPSLRVAALDTLCALMLQLGRDYLHFEHTVDKAISMYAIQHSNYEKAIEKLKKGEALPQNLAPRFEDISMEGFAAENNPPKKLTLNPVHLKQVWETKGKSTKDDWHEWFRKFSTTLLTESPNHSLRACASLASNYQPLARELFNSAFVSCWSELYEQFQEDLITNIENTIKSENVPPDLLGQLLNLAEFMEHDDKALPIDIRVLGREAARCHAYAKALHYKELEFLQDHNSGAVEALIVINNQLQQSDAAIGILRKVKTYREGIQLRESWFEKLERWDEALNFYCQREREIPEDQPVPVDIVMGKMRCYHALGEWDSLATLAGKTWANSAPEIQRRIAPLATTAAWGLGKWDSMDSYLQSMKRFSPDRAFFGAILALHRNQFREAMACIEQAREGLDTELSALVSESYNRAYQVVVRVQMLAELEELIVYKQCDGEKQATMRRTWETRLKGCQRNVEVWQRMLRLRSLVMTPQENMHMWTKFANLCRKSGRMGLAEKSLKQLIGTDSPLDSVIPYWHDRHPGSVGNRIASPILYAVLKFQWEIGQSPGFRNSEHRVAEKTLYCLQRFTQETAHRVETSRMHMAAHAQNGMEVQNQPGFAEFNEEMMHPQAQKHWLEQTVLLAKCYLRQGEWMVSLNKDDWQQRYRAEVLDCYYKATHYNNKWYKAWHAWALANFEVVQYLTGNREVDVRNNGEQNYIIQYVVPAVRGFFESIALSSGSSLQDTLRLLALWLTHGGHIDVHNAVTEGFTRVSVDTWLEVIPQLIARINQPHKRVQQSVHGLLADVGRAHPQALVYPLTVARKSWHNTRRVRSANQILESMRQHSLRLVEQAEIVSGELIRVAVLWHELWHEALEEASRLYFGDHNIEGMFATLEPLHELLEAGPQTLREISFAQTFGRDLSEARDWCRQYQETQDSNDLNQAWDLYYTVFRRITRQLPQMTSLELAYCSPNLLNAKDLELAVPGTYRSGQEVVRIMSFDATFSVISSKQRPRKLDIVGSDGKTYTFLLKGHEDIRQDERVMQLFGLCNTLLANDSECFKRHLNIQRYPAIPLSQNSGLLGWVPNSDTVHQLIREYRDSRKILLNIEHRIMLQMAPDYDNLTLMQKVEVFGYALDNTTGQDLYRVLWLKSKSSEAWLDRRTNYTRSLGVMSMVGYILGLGDRHPSNLMLDRITGKIIHIDFGDCFEVAMKREKYPERVPFRLTRMLTYAMEVSNIEGSFRTTCEHVMRVLRENKESVMAVLEAFIHDPLLNWRLTNPTSPPGPNFNAEREVAMPGGPGPRARRPSILDAPVAPTEFLAAQAAPGADGHGMGMSANPGRSRARTNSSAIYPTGSSMVNGHGNNQQEQQEVQNARALEVLDRVQQKLTGRDFKPHEELNVTDQVNKLIIEATKLENLCQHYIGWCSFW

SEQ ID NO: 23303 - protein, 805 aa, Neurospora crassa
MAQPITLTYLTVDVFTSTRYLGNPLAVVLTPASFRSHLTQDVKQLIAREFNFSETVFLHTLDDEARDGLTSTSREIDIFTIEEELPFAGHPTVGTAYLVLNHLGWKHVDTLVTKAGPITIRPTSEGRVKATIPHAVRIHKQTLGGILDGKGGEVKKETREMIEAALSEDPEIRQAELNGPVVSIVRGMTFLLVKLPSLEHLAKVSTAKRLDFSKVEGLLDKGEWERGFVSRYYYVPMEREKESENGRKEFKFRTRMVELGFEDPATGSAACTLASYLTVSGREMGGARFELTQGVEMGRQSEIEVETTAVEGENGEAKILHCSHIIKMLCALSGEVPEEPVVSRKTGAVFEKRLIEKYIQENHKEPGTDEELDVEDLLPIKTNRIVRPRPPQFTSLPSMLKAFQDEWDALVLESYNTRQQLARTREELATALYQNDAAVRVIARLTKERDEAREALSRLTVTASAGGAATGDAMAVDSEGLPEALAAHVDEVQAEKQKGRKKRPVPEGWATTEDISALQQTAYTDLPVTQATSLALNGGYAAVGGLDGKVDLYSVEAKAHERSLEVGEPVTATVWIGNKVVSATSKGSVKAVEGGVETGSVTEHAGAVTGLAVHPGEQILASVGVDKGIIFYDLQSLQRVARVYTDAELTSCAFHPDGHLFAAGTQSGQIEIFDTKTLQRMANFTLGAPVKTLVFSENGFWFAATGVGQSSVTIFDLRKEGDAARAKELQTGDVSGLAWDYTGQYLATAGSQGVTVQQYVKASKSWTEPLRTSTPAVAVQWGDKARQLVAVSKEGVVSVLEPKSE

SEQ ID NO: 23304 - protein, 628 aa, Neurospora crassa
MEAAAAPSTTFARLDGNPVLSDSVPPAATCNTGHRRTEPASTNICIDVTGSITFCPVPPLQLLLFCAMSTTAAKASGSYAAGPPDILRPRSHDLGGEVASASDGDDLLNALGYKAELARTRSTWHVAFMSFVLASIPYGLATTLYYPLQNGGPVVVIWGWVIISAIILCVAASLGEITSVYPTAGGVYYQTFMIAPAKYRRVSAYICGWAYVVGNITITLAVNFGTALFFVACVNVFQNDDGSDIWQAETYQIFLVFLAITLLCNAISALGNKILPLLDTFAIVWTFVGLICILVTILVVAKEGRHSGAYAFGHFEPTSGWPKGWAFCVGLLHAGYATSSTGMIISMCEEVQRPATQVPKAMVITIVINAIGGLVFMIPLMFVLPDIAMLVALPSGQPVPTILKSAVGSSVGAICLLIPLMVLGILCGTACTTAASRCTWAFARDGAIPGARWWKEVHTGLDLPLNAMMLSMVIQILLGVIYFGSSAAFNAFSGVGVICLTISYAVPIAVSMIEKRKHVIGAKFPLGKLGWFCNIVALAWSFFAVPLFCMPAYIPVSAGTVNYAPVVFVGFTSVSLAWYITWGHKNYAGPPTEQVGEDVATMTTGAASAIPGDIKKPVPVEGSLGKKD

SEQ ID NO: 23305 - protein, 1022 aa, Neurospora crassa
MSQPIERVFPIRLSILESSAFLRNVSDADDLLSVVPVTQQLSNQHLSPPSSDGSRCEPLPSATDRQANPQDSSSAASSYNYTYPSSFNKGNGGDDSLLSETFEYALLADGSHGVIQKARRAFTTCDEEPIHIPGAIQSYGMLVALKLVDERVAGPSRYLPRICSENSAFVCHYQPSELLSLDSFYQVMPNFQRHLFDVQLRHIRQGYDSTKKEQEPVVFAFSFSDPDGRLIPCWCAAHYLGGDTDLFICEFELQDYSMHPLATPAMSDPGNPIDTLGSDHLDFATACSIQSKVQPAFPNPELISKGFDPSTSSVEVIGMATKIQTQFSEAATVPDLLETIVSIVKEVTRFHRVMVYQFDRDYNGTVVAELMDPKASNDVYRGLHFPASDIPPQARKLYMINKVRVLFDRSQRTSRLIGRDVSDMDVPLDLTHAYLRAMSPVHLKYLSNMGVRSSMSMSLESDGKLWGLIVCHSYGPAATRVPFSIRELSFFVGLAASTCLQKLLNSERLQAHRIIETLRGRGRPDESPQMTVWYFTARTRSEKYIGQGGLRWRVWREKETAINDTRLKRLLLHDASHQALEKHLDDGTKQVLTTSYTASKSLIYVIDDLLSLTGSITGSVPLLDEPFHLPNCLEEVLCPLRRLGQEKGIQLIMIPSTGPTQYVRGDPTSLQRSLSILVANAIQHTTSGQVVVKWYETAMNPENTVIHISITDTGPGFSERELDDMFQEFEQVPDEDFDEATSKPHAVRDNVLRVGVGLAFVARFVKQRNGQLKVKSTKGRGSTFTLEIPFAVSSHCSSIASRRRDASPLPVLTMPGPLTFGAGSSVPSDRSTFGTSRDSKPSPPIIRPGSSTADTSPRDFQTPSPHHYTVIVADDNMINVQILERRLTKLGHRVLVSRDGQECFNLFASNRSTVDFVLMDLNMPVVDGFASIRMIRDQEYSHPTPSRVVQCCGRTPIFAVSGMLRRGQEQQCKEAGFDGWMPKPVDMKRLVRCLAGGLDPNARRMCVYDEKRFELGGWFDAE

SEQ ID NO: 23306 - protein, 2692 aa, Neurospora crassa
MAEDAAASPAPASTPSNAPADFDLVAAKAALTSSSTSARISQLRSIEEKLSQKALDRPTTLAVLKVLFWTHDFYHDRPSRTAVQKCLVALAQNREPEILTPLVAAIGQEIKKGAIAPGSAFTLVEWCSLLVQNLAGTPLWEKFGKDLTLSLAEVLEKCCQPASRGTVSKSALVITRRGLRKLAAGDDREKVIEEAVKALAAKGTQPTAKYAVLLGVIAGVCSRKPEAVPIIEKLKSQYFTFYTREIVGSRTQVPPHQAAALSDFFSSFVTLEDLDKEVFPSLEKGLLRAPEVVLNDLITPLVGALPQDFDLSAALHGKFVKPLLNNVKSSNAVIRSGAVTVFKGLAARSKDVALLEKVADEVLNPLKTGKLASADHRVLHSEMLVALVVSTGIANKIANGLPLVTGKEGNEAALSAETVALNASAVYLLNAGEEIPKPLADAYVKGLGEKKLPVRRTWILRAGDILYAFNKESQETLPANFIKFAEAVVTPLGTTFAEVVANPATAAQNGTVTGALVLCAVESLIRRAESSTFEAVYKKANIQKNSLAVNPKPSYLFNPRIYGKFADEDLKWLTSALTAVAPFLNGVGLPERVAWAQAFIYVISSAATGPDVRRDAIDALSTLYAQSSAKAEGPSALLAETIVEGLWHWIEATEAADKESAAALAKTGTSNLHLVLKAICLKPEEYQKRAGAEPDKTKLESQMCSLLVLAKSQLIPRASWIDLCLKVETDPGELARKYEQRLLDEIVNRTLYEQKSEAVRLAAYNAAAELVFVAPETMTPRIVDLIQQNLKVSEVQSVGPLEAAIFRTPEGTAFVDVLAKKQNVVPNKNDPNYHTLKWEEELREQIAQKKGVQKKLTAEENAKVNAQLKKEAEIRESVRHVAANLLRGFGIVKALATGPPTDASRWMGPAVKATLSVIDAGATLITGEAGPLAFISCSECVTSRVGPIRPFIGVATLRAHNVSALPENLTEEPFDDLITRALYRLRFAGEQRPFDVISLIYMLPLILLVLEKGGFGSNADDKDATLVLAIEFLSFHTDVYADEATPRAEILSTLITSMQNYNQHYKIIKDCFSDMVRCIAPNISAEEIAVLSRGAIVPQVAVRTAALQAISSDVDMSELSTSEEIWLACHDDVPENADLGRDIWEESEFQVTEELAFKMLPYLESKDGQLRRAAAKGLAEALGQNLSAVNPILEKLRESYTELAKPRLPELDEFGMPKKKDLSDPWEARQGLALAFQGIAPLLQKNQLEPFFAFLIDNGPLGDQNGNVRAQMLEAANTAIEIHGKSILDKLMKTFEKTLEAPDKGTAFADRVNEAVIIMYGALARHLKHGDAKIPVVIDRLIATLSTPSETVQYAIAECLPPLVRTCGDKSSKYIEQVIETLMTSKDYAVQRGAAYGLAGLILGRGVKSLKEHRILITLRSALENKKEVNQRESAMIALELLSTILGRLFEPYVIQIVPQLLAGFGDSNPNVREAALHAAKSCFAKLSSFGVKKILPTLLDGLDEDQWRSKKGACDLLGAMAYLDPQQLAQSLPEIIPPLTAVLNDSHKEVRLAANKSLKRFGEVIENPEIHSLVDILLKALSDPTKYTDEALDALIKVQFVHYLDAPSLALVSRILQRGLGDRSNTKRKAAQVIGSLAHLTERKDLVAHLPVLVAGLKIAIVDPVPTTRATASRALGSLVEKLGEDALPDLIPGLMQTLKSDTGAGDRLGSAQALSEVLAGLGTSRLEETLPTILQNVESSKPAVREGFMSLFIFLPVCFGNSFANYLAKIIPPILSGLADDAESIRETALRAGRLLVKNFAVRAVDLLLPELERGLADDSYRIRLSSVELVGDLLFNLTGVKVTDGEDEEEDIETVKEAGASLREILGEEKRNKVLSSLYICRCDTSGAVRSAAVSVWKALVHSPRILKELVPTLTQLIIRRLGSSNMEHKIIASNALGELIRKAGDGVLATLLPTLEEGLQTSSDVDARQGICLALKELIASASPEALEDHEKTLISVVRTALTDRDEDVREAAAEAFDSLQQILGKRAVEEVMPFLLTLLANEEEAENALAALLTLLTETTRSNMILPNLIPSLIKPPISSFNAKALASLSKVAGAAMNRRLPSIINSLMDNIINCTDDTLREELDESFDTVILSIDEYDGLNMVMQTLLQLLKHDDHRRRASTAFHLSKFFASADVDYSRYNQDIIRSLLLSFDDRDMDVVKSAWSALSEFTKKLRKEDMENLVISTRQTLLQVGVAGVNLRGFELPKGINAILPIFLQGLMNGSADQRVASALAISDIVDRTSEASLKPFVTQITGPLIRVVSERSTEVKSAILLTLNNLLEKMPTALKPFLPQLQRTFAKSLADTSSDVLRSRAAKALGTLIKFTPRVDPLIAELVTGSKTSDAGVKTAMLKALYEVISKAGANMGEGSRTAVLGLIDTEADERDDTMTITYAKLFGALVKNVSDEVAAQLLKNRVLTRDFSNSSVLALNAVLLESPETLLESSLVDDLPELLCQGMASKNTFITENFILATGKYLLSPVPKSFEATKPLFSTISTLLPPGQPTDSRRLALVLVRTLARTNPDLVRPHLALLAPPVFASVRDMVIPVKLAAEAAFVQLFAVADEESKVFEKYLESQEGNMAPNVKRSMQDYFKRVALRLGAQVRERREAEGGTGGLGLSNDEVEDEKELMSVGRVDVAGGGEMFD

SEQ ID NO: 23307 - protein, 316 aa, Neurospora crassa
MAEQLILKGTLEGHNGWVTSLATSLENPNMLLSGSRDKSLIIWNLTRDETSYGYPKRRLHGHSHIVSDCVISSDGAYALSASWDKTLRLWELSTGTTTRRFVGHTNDVLSVSFSADNRQIVSGSRDRSIKLWNTLGDCKFTITEKGHTEWVSCVRFSPNPQNPVIVSSGWDKLVKVWELSSCKLQTDHIGHTGYINAVTISPDGSLCASGGKDGTTMLWDLNESKHLYSLNANDEIHALVFSPNRYWLCAATSSSIIIFDLEKKSKVDELKPEFQNIGKKSREPECVSLAWSADGQTLFAGYTDNIIRAWGVMSRA

SEQ ID NO: 23308 - protein, 496 aa, Neurospora crassa
MAVHHQFDTVKRKWYHIKWFADSDTPRERRLIMKLDLLIVPYAFLAYWIKYIDQANLSALFLPAFFQSLLQPIKDSEVQLTPRYFPLTDNAYVAGLKEDLGFHGNELVQLQTLYTVGAVVGQIPFMFLFTYLPMHWTIPFLDIAWGFFTLAQYRANSFGQMAAYRFLIGWFEAAFYAAIHYIFGSWYRGDEISRRGGVFYTGLTLGTLTAGLIQSGASSRLEGVNGLAGWRWMYIICALVTIPVGILGYFILPGTPENPNKWFLKDEDVQIAKERLARVGHSVVHPKFKLGTLKSLANNWKFWALLMLDIFFWNGSLNYSAGGYLLWLKSLGRYSQSKVNELGTISPAIGIFYVLLICFISDLVVGPAWAITIAHVWNIIGLVILVIWNVPESALWFAFMTTYSSVAMSAVLYGWINAIMGKSSAERSFAIVLLNTVAQSTTAWTQLLTFPTKEAPQFKKGYSFVLANAVCLIITAQFLNVALKRSKVRKLKSLRL

SEQ ID NO: 23309 - protein, 592 aa, Neurospora crassa
MNQQSQQYQPARRPSAYASHGDELHMSAHQAHLSSPREYASSGAPHIKLEQMPSSPPNMQSYQSAGAVPNVLQPGGMSSRPPVMQSNTAPTLPTMQQSADYKSHGYERSSPATLASNSYDGGNSPYSAYNPTPPGGSSSSQYMSPASTNKYAAASSSRNVSNTPLGLSDIRPRADSTLSDGMLPGSQAYELANPQSRTSNYMAPWATYSFDWCKWRPSANSAGKLAIGSYLEDGHNYIQILEANLTQTPPDVYVPGTSKYSMDFTRTAEATHSYPVTRLLWEPPSSQKQSTDLLATSGDHLRLWSLPADPVVPTSGSSITSRSGRDAPITKLTPLALLSNSKTPDHTAPLTSLDWNTVQPSLIITSSIDTTCTIWDIPSLTAKTQLIAHDKEVYDVRFCANSVDVFVSCGQDGSVRMFDLRSLEHSTIIYEPTGKEERDANGGRISPTLAQQTMSHPPPLLRLATSPHDQHLLATFAMDSNVIRILDVRQPGQALLELRGHGGSLNCIEWSPTRRGTLASGGDDCQVLIWDLLNQPSGLTPAGQPDNVRSPVASWQCDYEVGNLGWVPPMGNGEYGDWLGVSAGRGVWGVRF

SEQ ID NO: 23310 - protein, 367 aa, Neurospora crassa
MGKKKRGHPDVEELLARPWCYYCERDFEDLKLLISHQKAKHFKCDRCGKRLNTAGGLSVHMNQVHKESLDKVENALPNRQGLDIEIFGMEGVPDDIVQQHNQRIITNFYTAQAERHAATGNPPPGQAGGQGPAKKIKIETPEELKKRLADHRAKVAAIKANGGVLPVPVVAPKAQPASVSPVTGQSPAQGASPFPPPQPGFPYPPPVGVPGAFPPPGQPGVVGAYPPVYPPPGATPTPPGAPGGPGFNLPARPTGGALPQRPPYYNNYNGGAVPPPGAYPGGASTVDELVSGAARQGGGGAQGDEIDQLIRAAEQGSKAPARAGEDSAGGEKKGKSKDKNMRMVYGDSEVSPEEKMALLPRYAVSAA

SEQ ID NO: 23311 - protein, 1533 aa, Neurospora crassa
MYSNSNAFLGGANSLRPGQQPQQQQQQYGAPSPFGQQGPMQPQPTGFAPQPTGFAPQPTGFGQQQTGYGQQQQQPLQQQFTGYPGLQAPQQQPQLQQQFTGFQPQATGFQPQVTGFQPQATGFQPQAPQQQPFQTGMPPVPAIPQQFQQQQSFQQQQQQQQQPSIQQPQPTGFPSVQIQAPAQQPAPTAQGGIAPPPPVKPQATGFSEMAASFQTAGGKGRRAEQKTNTVKIPNIRLSFITAHDQARFETLFKSAVGEGQTTMSGEKARDLLLRSKLDGDSLSQIWTLADTTRSGQLHFPEFALAMYLCNLKITGKALPSVLPDHIKNEVSSMVDIINFSITDDAGSSSAPASNAPSFATQQNTAAVPTIQQPQPQPSNSAILQAQMTGFPAQQTGFMGQNQGLQPQQTGFPGMNPQPTGYAGPMPPMPPMPTGFGSNLSPNAGPGGMVAPLNSQPTGMPGQWGLVNTPATGLPLIDALQARMMPQLGREQRNYTTAGLQGNAVIPWAITKDEKTRYDALFRAWDGLNKGFIAGDAAIEIFGQSGLDKPDLERIWTLADNGNKGRLDLDEFAVAMHLIYRKLNGYPIPNQLPPELVPPSARNLSASIGMVKNMLHQESELRKNTGASLLPQKTGVSYLKGHSFKNTGANRKDATVFKNNDEEVGYRSSARRRVGTSPRPESPAASNSGDDLTIEQLRKKIKEKQVLLDAMDFNDEKNMEEDDILDRRDRREADELYRRIRRIQEDIDNHPDAQLMSADSDAERRALKRQLQQLTDRIPELASQVRKTEKAIADARLELFRLKDAKAHPNSAAAIVGTGPGGMVTESDRIKARAKAMMQQRTAALMGKKIDIGDDDADGPKRLEEENIKIKTEKENNERMVRDVEDSVREFAKGIEDSLKEGAPDSTSEHEKRRWEDALGVEDEVRDFIFDLQRESRAARIRSQDRQGGRKATQEPVKAEAPVSTRVETPSPSISRTSTPASTAGGGSYSSYKTPEERAAFIKQQAEQRMAERLAALGLKAPGKPGETAAQRAERERAERAEKRRQAEEEDARREAERQAKLAEEEGGPAPVASPKADSRPPPPPPSRKAGKADDRRDEEAAAKKAEEERLEREREEQERETRELEESAKAQEDELAKERAEADARLKALEEQVRLGKLKKEEEKRKKKAAMAEAKEKEAQLAARRAEIEAARKREEELRKQLEAIDDEDSSSSDEEGPEQITPQASTPTVGGSQVGTHEQEPNSPPPPAPASVASPPQIVTTSPNAERESRNPYFKMMSQSSEASTSSVAAPVASPPPPADVSTNPFHRMTQAAAAPAAAVSSAVSGAVSGISDAISGVMPSRRRPNDDDDDDWGSEKGSDDEDSDDEGRPGGNSAAALASILFGTMAPPRPLSATGEKPTASTPPVVSSPSSPPPPPAPVEPSAGSPPPPPPPPPGPPPAPSGGAPPPPPPPPPMPESGAPAAPPPPPPPGPPPAPGAVPPPPPPPPGGAPAPSLPAGRPAGLLGEIQAGRALKKTQTKDKSQAAVAGRVLD

SEQ ID NO: 23312 - protein, 666 aa, Neurospora crassa
MDGSLMAALPQGQDVIRVISTGGVTKVVKIADCNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLNQYGALPESLVRSFVRQILQGLSYLHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 23313 - protein, 344 aa, Neurospora crassa
MDVVLEVTDQFMFDYMYAWLLPARPALYDFPDKTNGTAQAFSSWVYEPATKFFSLEPSQAAYQSIWTRDNIYRQALSLFLILWLFGLVTYYVFASLSYIFVFDKKTMEHPKFLKNQVWLEIKQTNAALPVMAFFTFPFLVAEVRGYSLLYDTTAEGPGRWYDFFQFPLFIMFTDFGIYWIHRGLHHPLVYKHLHKPHHKWIMPTPYASHAFHPIDGFAQSIPYHIFPFIFPLQKMAYVGLFVFINFWTIMIHDGEYYANNPVINGAACHSVHHFAFNYNYGQFTTLWDRLGGSYREPDGDMFAKEKKMSTTTWKKQVNEMEKIVKEVEGEDDRLYEPTETKKSK

SEQ ID NO: 23314 - protein, 116 aa, Neurospora crassa
MTDAPASAPVVKKNTAAESKGKKADGKPRFEVKKWNAVALWAWDIVVDNCAICRNHIMDLCIECQANQSSATSEECTVAWGICNHAFHFHCISRWLKARQVCPLDNRDWEFQKYGR

SEQ ID NO: 23315 - protein, 710 aa, Neurospora crassa
MPAAVHGTPYLPDGAHQGGGGLSGADQKIKTLSPAVAAHLQRIYSAHADTVTKAWRQEDVSVWLRCCQGDDEAELARDFPLHQDWDYESFFQYITSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTTTPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGSTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGYRCAKLTDSNPSPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKGMESDGAVLVKISKKLRL

SEQ ID NO: 23316 - protein, 353 aa, Neurospora crassa
MGCGMSTEEKEGKARNEEIENQLKRDRMQQRNEIKMLLLGAGESGKSTILKQMKLIHEGGYSRDERESFKEIIFSNTVQSMRVILEAMESLELPLADQRVEYHVQTIFMQPAQIEGDVLPPEVGNAIEALWRDAGVQSCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 23317 - protein, 258 aa, Neurospora crassa
MGSNDSSSLPALATNPKFVFFTDFDGTITQQDSNDFMTDTLGFGPALRKKGNESVLFGHRDFRDSFSEMLDSISTPFDQCIETLLKNITLDPGFKEFFHWAKEINMPIVILSGGMEPVIRALLAHFLGKEEADSLQIVSNQVAVRPGKKSLNEEGGWMITYHDDSGFGHDKSLEIRPYANLPADQRPVLFYAGDGVSDLSAAKETDLLFAKAGKDLITYCEKENVPFTTFHDFTEILAVVKDIVAGKVTVKEAAVGRK

SEQ ID NO: 23318 - protein, 1053 aa, Neurospora crassa
MPSSEGPPALSRTRTGSATTDSADLGTGNPHSLHQAIYARREEYTRPHRIRVKVGTWNVAACPGTDKDLASWFVDGKGIDTALATLDLNRNAAIEGDTDGEDGVHILGRDKIGLYVLGLQEVVDLNTASQYVSRVYSGDEGVTQKWKTALDTALPPGYKLVASEHMTGLLLLIYASPEVAPTISNVSTVSVGTGLLGYMGNKGAVVTRIILGESTRLVFVNCHLASGIEGTYNERRIWDVGQILGRTRFKPVSFAGVSEDYEEKIGDEDFTFWFGDLNFRLDGLPGDDIRHLLMLHTKGEYGAPRPRFRRDNSLEGEPIIVHADKSSDAGDETNDGNSTTTHSTGDTKATDYDSDSDLDALPDPDDFLPDPHDDPTSLQATLDSLLPHDQLTRLIKQKKVFHDGWHEGTISFLPSYKYDVGTVGLFDSSEKRRAPSWCDRILYRTRKDKEAYDKKIKEAEDARKKDEEMKARGIDQAGDDDEVLFDYDPDNDGDDDHSPDVSRLEYDEYDEGEEGDNQHDRDDWVDRIRQDIYTSHQRITSSDHKPIISIFTLNYDAVVPDLKAKVHAEVAWELDRAENEGRPSLTVVNDSRDTRGPGRPGGSQDSAEELVDFGEVRFLQKQSATLTLANTGRVACTFSFVDKPSPAKEDGPIPPPWLKTSFISSEPAVDDSRLPDLGKEVTLEPGETVRAQLQVNINHVEQARVLNSGRDRLEEVLILRVADGRDHFIPVRGVWMPTCIGRSIDELIRVPEGGLRKFVHSLTAKNSGKVMSVPEEMDVHCAAPRELFKLTEALESVTERVLADEQMLEEYKVPRSSGWPFEEDTWRVTDKSLRASRAADLIDALDEGMVHIVDAFSAEVPAVERIETVAEVLTLFLRGLTDGIITTSLWSRIEQASLVSLGQGAPASSKIPPQETAYEQDKGTILDILSTAPNHNISFVFLTATLAKVTTDLSPITKSDLELLKSDTPVRLSVLNRRSLTAGLVKRNTSSGSSGQAMAAMAARQAKERSFAEVFGELVCRAPVQKGMKDKERKAVEEKQQAVLELFLRRRGD

SEQ ID NO: 23319 - protein, 304 aa, Neurospora crassa
MSLAKVKHIVLVLSGKGGVGKSSVTTQLALSLSLAGHSVGVLDVDLTGPSIPRMFGIEDAKVTQAPGGWLPITVHEADPSAGVGSLRVMSLGFLLPKRGDAVVWRGPKKTAMVRQFLSDVFWDETDYLLIDTPPGTSDEHISLAENLLQKARPGQLAGAVVVTTPQAVATADVRKELNFCTKTNIRVLGVVENMCGFVCPNCSECTNIFMSGGGEVMANDFGVRFLGRVPIDPQFLVLIETGKRPTYPAGTTVDGKDISTPAGASTSEEEEVKDGSRLVHKYKDCSLAPIFSKITADVISAVQQ

SEQ ID NO: 23320 - protein, 244 aa, Neurospora crassa
MKLAFGLVIFGQLARLAYAASLVRLPNQHVLAGELDNGDQQAAKLPHEVRKALKKAEIIPTVKWSHGIKASLGNTLKPKDLQDPPSIRLKDLVASTACLRHSSTSLVIVITDPDAPSRDDPKWSEFCHWIAVGPLVTADCPISDEQTQIHGCCSSDSLGTLEDIVSYTPPAPPEKTGKHRYVILALAPVNGTSEKLHLSKPKERKRWGYDKAVHGKTHGVREWAVENGLVPFAANFIYAQNKKQ

SEQ ID NO: 23321 - protein, 109 aa, Neurospora crassa
MSDAATQKAKQLINDNAVVVFSKSYCPYCSNTKQILDGLNAKYATYELNQESDGSDVQDALLKLTGQRTVPNIFIGKQHIGGNSDLEAVVKNGKNGKKIQELLQEAGAL

SEQ ID NO: 23322 - protein, 645 aa, Neurospora crassa
MWAPPVRYGDENIPPADPTHQSKRSDSKIKAMMAVNGTLNAPPKRAACFDKSNTSKPLADGGNKDMLKNRVKPMVTTSSTRDLRSDGRENNRSAAEEHYMRPTATSKAASHGHQKYSSTAPLSSHAASGAYGGIRSHNAIAKLSAPVKKTTNVYRDNKVKEESTSHAPTSSSVDDLVAMVDKHIKDPRHYKSQPQLKSDQQHTLHRNQSKYVPNYENLNDVDDPDDSNADYAESYEDAVEQLSRDLDIPANTDPAAIVHANHMSIAQASYDSMPQGAPLAPSKPVRALPLPPNVSDPEEYSEDDDDQDLYDDQGYTTAHSYRSHCDNTTGGPPTLVAPKFTADIQKELDIAKAWVLEHQTEEEVEEENWDVSMVAEYGDEIFEYLRELEERMLPNPHYMDIQTEIRWSMRSVLMDWLVQVHHRFSLLPETLFLTVNYIDRFLSVKVVSLGKLQLVGATAIFVAAKYEEINCPSIQELVYMVDQGYSVEEILKAEKFMLTMLNFELGWPGPMSFLRRISKADDYDLETRTLAKYLLEVTIMDERFVGCPASYLAAGAHCLSRFFLQRGPWTHAHVHFSGYTLAQLRPLIISILDCCQEPRKHHGAVYDKYSHQRFKSASTFVEGKIANGFVLPIRTNASISDSAQS

SEQ ID NO: 23323 - protein, 1151 aa, Neurospora crassa
MSSTTEALLVSQNSPSTLPEAISRTMAPNTSPSRRARPAHVQTALTLQPQAFTNVSPLSAISTSSASPTSQQPSPALTPDTAGAIFTESSSLQGSPATFVSSTTKGMDSYASTIKGMEEPVTPLNLPEPLAPAPLSSKKSSNSLKRNGEKSGEKIPRQQNAMGEALSKSSFAGSLVRRASNTVNKARDILTRRASMNIVNRDADPMVASLRRGSNTFPLGEHNYRGHLLESDDECAIDDAGPLDGLRDAQIPLSIGPEIPVALRQGVMLKKISKKKKEKRITLTLDPDTSKIWWDKSRTGRKSVFIDDIKEVRTAEDIRQYRLDAGVEESEEPRFFSILYTVPEKSGTKVLHLIALNSTDFRNWTTTLDAILQYRQDFTTNLMAFNEKAVHEFWQRQMRKKYADRVIPAEGETIELPDIERICRSLHMHLSPTEIRDNFNAAKAAKATSNGVCDPTSPSSLNFNEFKEFVRLLKARSEISHVFKNHTTNPKAGMTRQEFIQFLKEIQCEDVEEDSTHWNNIFSQFARRRRSKDAEQTISGDESLTISEAGFTGFLNSHFNSLLIQEPSEYVLDRPMNEYYISSSHNTYLLGRQVRGISSVEGYISALERGCRCVEVDCWDGPNDEPYVSHGHTWTTRIKFEEVIKTINKYAFVKSRFPLWISLEVRCNAATQANMAKIMIDIFGDKLVRAPLDPSSDRLPSPSDLIERILIKVKKSQPVPNTPSEESLKTERPGRRRGNSLPSPYQRPSPLPSPMDNTSVAVPGSPSLSPSPMLRATRQINTITEGEVHSHGGPSNSPSEYESDAEKDSGKKVVSKINPILGELGVYCMGVHFDGFDSPDAKKFNHIFSFKEKTFAERSQPGEAKRALYRHNMRYLMRVYPNGGRISSSNFDPLLYWKRGVQMAALNWQTFDLGMQLNQAMFDSGTDLSGYVLKPLEGRQIQVVPTDAAGQLSGKRPRKRISFKIEVISAQQLMRPLNLPKGRTLDPYVEVEIFLADDKRNKQDGATNAPAQETQLKYRTDIVKDNGFNPVFKGNNSYEFIVTTKYPDLIFVRWSVKLGDNKGYNDRSPPLATFTAKLGGLKQGYRTIPLLDHNGYNYLFSTLFCKITKSQPTDIMVTYSSEVPRNSVSRIKNIFNQSGISPKSSMDSGRA

SEQ ID NO: 23324 - protein, 484 aa, Neurospora crassa
MVMPTVVSDRMGTIDFIDYTNNHVFSKCQTDSLNTVNNGSLKHDDYLHGLANGKLVAKQMIGDALRQRVESIDSEFCEPGDEDTFFVADLGEVYRQHLRWKLNLPRVKPFYAVKCHPDERLLQLLAALGTGFDCASKAEIEQVLRMGVDPSRIIYAQPCKTNSYLRYVAQQGVRQMTFDNADELRKIARLYPDAELFLRILTDDSSSLCRFSMKFGASLDSTDGLLGLARQLGLNVVGVSFHVGSGASDPTAFLKAVQDAHVVFQQAAAYGYSLKTLDVGGGFCSDDSFEQMANVLRAALDEYFPAHTGVNLIAEPGRYYASSAFTLACNIIARRTIQDGSAVSVSDSSSMSDDGSVNNGDARYMVYVNDGLYGNFSSIMFDHQHPVAKILRAGGRTMYNSVAAHESSAEDAIEYSIWGPTCDGIDRITESIRFREILDVGDWLYFEDMGAYTKCSATTFNGFSNEHDVIYVCSEPGAMALLGL

SEQ ID NO: 23325 - protein, 223 aa, Neurospora crassa
MASLKSLLSGFLLLAGAAQALKFDLEATSSHHSNQRRCIRNFVNKDTLVVVTATLDGYKGDGMNVNMHISDSHGNEYGKAKDIAGEQRIVFTSHHDAAFDVCFENYLTAKYVENPRRHVELDIDIGADAKDWSAIQATEKLKPLETDLRRIEELVGEVVNEMDYLRAREQKLRDTNESTNNRVKWFGMATTFLLIALWGWQIMYLRAYFRFVFPSSGANGFSY

SEQ ID NO: 23326 - protein, 380 aa, Neurospora crassa
MASTVGKTITCKAAIAWGAGQELSYEDVEVAPPKAHEVRIQIKHTGVCHTDAYTLSGKDPEGAFPVILGHEGAGIVESVGEGVTNVKPGDHVIALYTPECKECKFCKSGKTNLCGKIRATQGRGVMPDGTSRFRARGQDILHFMGTSTFSQYTVVADISVVAVNPEAPMDRTCLLGCGITTGYGAATITANVEKGSTVAIFGAGCVGLSVIQGAVANGASKIIAVDVNPSKEEWSRKFGATDFVNPSTLPEGQSVVDKLIELTDGGCDYTFDCTGNVKVMRAALEACHKGWGQSIIIGVAAAGQEISTRPFMLVTGRVWRGSAFGGVKGRSQLPGLVEDYLNGKIKVDELITHRKKLAEINNAFEVMHQGDCVRAVVDMS

SEQ ID NO: 23327 - protein, 313 aa, Neurospora crassa
MCFGGRGKDDEAEASRSRELDKQIRADEKRLSKEVKLLLLGAGESGKSTILKQMKLIYAQGFSKNEKLEWRPVIFANILQSFRLIFDAMNEFNIKLEDEDNEASLIQWTLISAPAKKLWQDSGVRQAIEKGNEFALHDNLQYFCSDLDRLWDRNYVPSDQDLLRSRLRTTGITETVFDLGQLTYPISGYDQCLVEDKDGNQMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 23328 - protein, 888 aa, Neurospora crassa
MATLVSDLLRGAQRQVRRFSSGFAAEEPDISTPSSTSQHQRTRSDGAALPESVFEDGDENYRRSLDGIVVGRTVAQPVAVVTTTTTTPTNVASSSHSRLGEAADVATATPEAGHTGQVPVPPTSAAAYESTPPARPSLTSPISAPAPEWTAQAAQQSLLTLPRIPSQVDSDARSQTGELPEDDGKSALRKRIQAIQNQADISQALKAQLIHQVMTEEYYQQSPHAHDGTMGMRPESPSGRSVRSVHSVKSARSAQSHSRDRSSNRDRDSFGPLQTALKFWNPLAGESGFSDEDTLNIHVTEEDLKPTYAPKTVPKRDEYGVRELDVSLAYAIAQGIQPEEETEDLDEHGQPVLRLGCKHYRRNVKLQCAACDRWYTCRLCHDEVEDHTLPRRDTRHMLCMLCGRTQKASQTCVGCNQSAASYYCNICKLWNDDRNKPIYHCNDCGLCRVGLGLGKDFFHCKKCSACVSTRDEHRCIERSTDCDCPICGDYLFNSPRPVAIMKCGHTIHKHCFSAHRERSYRCPVCNKSCVNMEIQFRNLDIAIATQPMPDEYQDARAVISCNDCSAKSQTRYHWLGLKCSVCHSYNTVEHKLLHMPGVDGDQAEEEPRAVTGSSDANNGAQGVSMLPVALDNAATAGDRRLSAARGLDPQYPDTNGQQNRSIFHSDPISPPRRSALAGLFANRNRQSPSSSSADQPHPSTSNLPTTPSPSTYFPRPSSFAPSSPAATAAAVLASAAALVGFGGYSASAPSGAANNTLISDRAIPGMTTTRTTRRRTRGRSINEAAGPGVTTSADYNSDDYTDDDEESRWGEDMVTLEDVLGFLGRSPRRLVPVPQDGHTSIRDLIDEDDEDDESGEEESEEENYDDDDDDDIEEIGDGGFELDLIGHR

SEQ ID NO: 23329 - protein, 520 aa, Neurospora crassa
MVHLTIIPKEDEIRDGLDIPLTGALKAVHLQLANDEDRFTTSVYGSKFAAADLPRHEMPDEEMPKEVAYRMIKDELSLDGNPLLNLASFVTTYMEEEAEKLMTESLPKNFIDYEEYPQTADIQNRCVSMIGRLFNAPVKDAEASSAVGTSSVGSSEAIMLGVLAMKKRWKNKRIAEGKPADKPNLIMSSAVQVCWEKATRYFEVEEKFVYCTPDRYVIDPKETVDLVDENTIGICCILGTTYTGEYEDVKAVNDLLVERGLDTPIHVDAASGGFVAPFVVPDLEWDFRLKNVVSINVSGHKYGLVYPGVGWVVWRSAEYLPQELVFNINYLGADQASFTLNFSKGASQVIGQYYQLIRLGKHGYRAIMSNLTRTADYLAESLAALGFIIMSQKSGQGLPLVAFRLKEDPDRTYDEFALAHQLRVRGWIVPAYTMAPKTEGLKMLRIVVREDFSRNRCDGLISDIRSCQGILEQMDKETVKKQQEFIHKHHVVSGKASHNHPKYHEKHSLQGKTGKTHSIC

SEQ ID NO: 23330 - protein, 532 aa, Neurospora crassa
MADSIRNESTPTTPSPDQMYCHACHHQWQRQGETLQCPACNNATTEIVSNQTSSTTLDTRTTLLTQDHQITPENDPRHFHRRPLPATVEDAPAEDELQPDYSAAATVTESQQPTEVPTSNTETQNANESNGHNDARPQTEANGTSTTSGNTQTSDETNTRGTQEQTSNASNTEAPRSGSRSTNTQHFDIRFIFPPMTFFTTVISEPLTPRSQQQPAGSQPNGQAQSTEQSNEQPNNQQSNASNTSTNVPTPNGSTASGPSPITFFGLHFFTPRPPHAHTAPASNAASNTTQTEGTAQQQSQSNDEQAQASQQQQPQQGPQPATQGQSSPFGSGPVPAGLMNAILSAMFSPLSPLVLGNLNFVNDGVYSQEAFDRIITQLREQHAAQNPGGAPPASQAAIEKLRVKDIDEQMLQGCQDNKAKCVICVDEMTLGDKATLLPCNHFFHGECVTPWLKVHNTCPVCRRSVEVEEAPESKKRKNVAEHEPTGRDGHGIDEAEDEDEQQSAEVAAAIPERQRRPYGPERLRGEGTDCA

SEQ ID NO: 23331 - protein, 487 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 23332 - protein, 902 aa, Neurospora crassa
MSDIPSNTSDTSEAKEPVSLSGMIVTLVPILITSAIYLAIFLVLRKSNRRYYAPRTYLGSLRENERSPSLSNGLFSWVKDFWKIPDVYALQHQSLDAYLYIRYLRMAVTICFVGCCITWPVLFPVNATGGNGLKQLDILTYGNINRETRYNRYYAHVFISWIFFGFVMYLIMRECIFYINLRQAFLISPLYSQRISSRTVLFTSVPEPYLDEQRLRKVFGASVKNVWITSETKEVDELVEERDKVAMRLEKAEVKLIKLANQIRRKAMSKGDVNDVDKQAPLDAESGSIAARWVPRNKRPTHRLGPLGLIGKKVDTIDWCREELTRLIPEAEAAQDKYRDGAFKKVPGVFIEFRTQADAEGAAQILAHHRGLHMTPKYIGIRPNEIVWKSLAIPWWQRVIRRYAVYAFITAMIIFWAIPVGVVGIISNVNYLKTISFLTWLDDIPGFILGAVTGLLPSIALSILMSLVPIVIRICAKLSGEPSLSRVELFTQHAYFAFQVIQVFLVATVASSATAVAKQIADNPGSVTKLLSENLPKSSNFYISYFIVQGLSIATSVLTQVVGFFVFNLVYKFLANTPRALYTKWANLSAISWGSTMPVYTNIVVIAIAYATIAPLMLGWATVAMGLFYLAWRYNVLFVTDTQIDTRGLIYPRAIKQLYTGIYLAEICMIGLFGASVAPGPLVLMVIFLIFTILFHISMNAALNPLLYNLPLTLLAEEEGPLLDTPVDSHTAENGLGGEPRNGVSPTTGANYTEKVPSNGTNGAQSRAEDPILGAKEALDASRHQPNHVTGKKPNFLVKFLKPWIYSDYDTLRAYLPRGVQLDPYTEEVERDAYCPPNVTSDVPLLWIPSDANGAGVSRQEVEHTSRVVPITDEGCELDEKGHLVWDREGTRPPIWEEKIYY

SEQ ID NO: 23333 - protein, 526 aa, Neurospora crassa
MAEYVFSDAPKDSHGNGVKDAVPGKQPEELPPAPRYFQGENTAGFMRPVRFEGDITNLEVVGEIPKSIEGTFYRVMPEPHLPSFIPNDPWFNGDGNISGFYFKDGHVDLKQRYVRTEKFVREAEARRSLLGKYRNRYTDLVEFKIRSTANTNIVYWRGQLLALKEDSPPYAMDPETLETFGVYDFDGQLPSLTFTAHPKFDPVTREMVCFGYEAKGDGTRDICYYSFGPDGKIAETVWLVSPVCGMIHDFAVTENFVIFPIIPLVCDVERMKQGGDHWQWDYSIPMYIGVLPRRGAQGSDVKWFEAPHGFAGHVANAFEDDKGHIQLQMAYAKDNVFFWWPDANGKGPRPGEVEAHFANFVLDYQSDKLPLAEPTYLVDDDMEFPRIDDRVATRKHKHTFFCIFDRKPGVTDFEFVMPRAGGGAPMSNGLAHLNHETGDIQRYLPGPRKLTGECIFIPRNSEAAEGDGYVMVLLANYEDMCSELAVLDTKDLTNEVALIKLPVRLRPGLHGNWVDKSDVDGHPAPL

SEQ ID NO: 23334 - protein, 355 aa, Neurospora crassa
MAEFIRAQIFGTTFEITSRYSDLQPVGMGAFGLVCSAKDQLTNQNVAIKKIMKPFSTPVLAKRTYRELKLLKHLRHENVGLPDSIAQAIGNHATNMLAQQVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADSSAVDLLERMLVFDPKKRITATEALSHEYLAPYHDPTDEPVAEEKFDWSFNDADLPVDTWKIMM

SEQ ID NO: 23335 - protein, 549 aa, Neurospora crassa
MTGNITAALERHASTVTRLSSQISSYYAARLPYRIFHGSTNSTRPPTQKGTNTKFVDISSLNNVLSVDRATKTALVEPNVPMDKLVEATLPHGLVPPIVMEFPGITAGGGFAGTAGESSSFRHGFFDDTVREVEMVLGNGEVVKVKNPDLPREVSSTATAAENGGDLFRGAAGAVGTLGTTTLLEVQLMDAKKFVKTEYKRANSVAEAIRMVREETQNAENDYVDGILFSKDHGVIVTGKLVNELPSPPPSSSSSSASEKPIKPQTFSGPWDPWFYLHCQSRTLSPSTSTTPNSSPVVATDYVPLAEYLFRYDRGGFWVGAAAFQYFSWVPFTKLTRWFLDDFLHTRMMYRALHGSGESARFVVQDIAMPFETSEEFINYTSSSLGIWPLWLCPLKRRAPPTFHPHTTRPGTDPSDEKAQDDMMLNIGVWGWGPDSPQEFVAKNIELENKVHELGGMKWFYAHTYYEQEKFWKMYGGRTWYDALRKKYHAEHLPTVWDKIHVDADKAGKKQRHWLLAKKPIGGFYGIWKSIQSKDYFLHRKAQWKWKGE

SEQ ID NO: 23336 - protein, 529 aa, Neurospora crassa
MVLGFQFSFHSPPLNPVTKKAQRVPIFNPIDRHGRVFFFSWTGFMLTHTIKHSLHLTPAQVANSNIISLLATLLVRLISGWACDRYGPRLVFAFILLLGAIPIGLAPTITNVTGLYVIRFFIGILGGSFVPCQVWTTAWFDKNVVGTANAVAGGWGNAGGGVTYFVMPAVFDSLVRNWGMSDGKAWRVTFVVPLICLLVVGLALVLVCEDMPTGRWRDRNQGVEVPVVIDGVDLKSGSGAETPMTTTTKMDEEKGSKSVSDTESTTRPDVEKGEVVSAGPSNTTTIPSVTTILLSPQTLFHILTYACSFGSELAINSVLSSYFLSVAPSSLSQTSAANYAAIFGFLNFITRPLGGLASDYLFSFFGGSSPCSSPSSSSLSPSSPEAKPKALWARKLLITTCTLLTGTFLLLLGLLRPSSLGTAIGLVILAAIFIEAGNGANFGLIPFVHPERNGVVSGVTGAGGNLGGVAFALVFRFVGGHGMKGGYEKAIWIVGIINLVVAVVGVGIKPVPVAGMGSTKKEGGRRWFW

SEQ ID NO: 23337 - protein, 925 aa, Neurospora crassa
MANMANSLLNMVIDGPKDGNDEESHPYPDSSSKSHGAVSAHNSDCLQAMTQHQEHDHFNDNDSHISASASTPSTQAMEEDHAWSVATRTTTQSSIDDTVTLQRHVPPTHPFAAPDMSLIFDFSPVPLLLLSSSCCITRVSKRFCQDWHVTEEDCIGKFLLPFLESQIRETGASKSRLIAEAVDDAVAARSERTSKAITVKSAFTCRARVIPIFRDAELVSIYLEWHERPSSEVLDNEQVQPGLSTDEAFRILVQATKDYAIFLLDTKGHIATWNTGAQLLKGYTREEIIGKHFSIFYGKEDLDIKKPDMELDICLREGRVEDEGWRYKKDGTRFWANVVITAVYKNGVHVGFGKVTRDLTERKASESRLIAAYEESEKLKSDFLANMSHEIRTPMHGMLSACALLLDSPLTERQRDIVNIMDESGQILLQVINDILDYSKLASGSFSVSSDVVGVASIITSVVRAVQTTLPPAVHFELFLAPNLPKSVQGDPLRYRQIVQNIVGNAAKFTDKGSIRVKASVDSEDNDSYTILTEVIDTGIGIRESASASLFTPFSQFDLTTTKRYKGTGLGLSIAKSLAELMGGRIGYRPNPERHGSVFWFTARFKKIKSLEQIQDWKHQMAAKDGSPISPIQPDVTVLQQRLASVAGTKSILLVEDNVINQKVMLGMLRSLGFRSIDLAADGAAAVKMVTGKPVGYDIVLMDINMPILDGNEASQKIRDAGVKVPIIAMTAYALKGDREKCLEYGMNDYVPKPVDRKFLIKVLATWILEKVDYRKAYDERLQQLKDCDEKLHRLSVSEGVAAARRESVDGGSKPGMALQGDEGVVKGWASPFREVDQAQASNAGVRQGTFQEPASVRIPKMLAQRTERTKVGPLPLPSGDQGAPMLSDAQQGKQELPNGGFAEGEGLNQLPPVSDGEISPRTLV

SEQ ID NO: 23338 - protein, 636 aa, Neurospora crassa
MPSILSDDDKETVKRCVPKQTNKIHAVAVARLYVAYPNPSRWTYTGLQGAVVLANDLVGNTYWIKMVDISPGNRGVIWDQEIFDTWNYNQDRVFFHTFELEECLAGLSFVDEKEAKQFLKKMNDREKNASKATSKTPFGGASQAHHHKHHGLFGGLFGGHKHASPTATPPESPRAAAPAGRMRAGSTNGINGYKPPSEFATLDAFDPLWREHFGDDLKAQGLDDDFIRENQDFIIEFLKQEQAKQGIHTSTPPPPPPPPSAPPNGPAMRAPPPPPPAAAPRSVSESITPSTSRRGPVPPPPPPARRSGKLDTENHQEPAPPPRFAVPPPIADAGKFAHSDPPRHTPSAPGPPPPPRPPKTPLEDQDPSQRFSVPPPFTGQRSVPPPPPSRSSVPPPPPPRNSAAQPPLPPKAPGPAPPLPPASSRPPPMLPTRSPAPPQAPPLPTSNAPPPPPLPATQAPPPPPLPATSAPPPPPPAPPAPPAPPLPAAHAPPPPPPMPPMPAPSGGAPPPPPPPPPGGMGGVPPPPPPPPPGGMPPPPAPALPPVDGSRSAVLDGIKTAGGIRALKKVDRSQIRDRSGAAVPGGSDSGPASSGLPPAGAAPGGGGGMADALALALQKRKEKVSKSDDEDDGDDWD

SEQ ID NO: 23339 - protein, 346 aa, Neurospora crassa
MAANDQMDIEVAEQKLKSMDHAEQHYFNSYNHHGIHEEMLKDEVRTKSYMHSIVQNKHLFKDKIVLDVGCGTGILSMFAAKAGAKHVIGVDMSTIIFKAREIVKVNGLSDKITLIQGKMEEIELPFPKVDIIISEWMGYFLLYESMLDTVLYARDRYLAPGGLIFPDKATIFIAGIEDGDYKDEKIGFWDNVYGFDYSPLKETALSEPLVDTVDVKTVVTDPVNILTLDLYTCTTADLAFKTNFELVARRDDFIHALVAWFDIDFTACHKPIRFSTGPHTQYTHWKQTVFYLKDVLTVQQGEKVQCSLHNRPNQKNKRDLDITVDYKFENQDPTRQAEGRCLYKMC

SEQ ID NO: 23340 - protein, 2140 aa, Neurospora crassa
MPVPDPFSLADRFTDESSKDAGPSSSDDEDDGVVVRANAPTEGITFNGSIHYREDLNPSLGRGRGLLWKRPTIIPRQPSPVQVIIRKSSSPAKTTTTTTTTSTSNHHGSGTKINNTRTGSGSDSDSGDSSSSSSSKVNSSGTSRSKKTINDRETTRPPFTQQPKPTTVKTMFKPTTSTQPDPEKPPAQVHDEEEPKRSYHPLLKPVFGPARKTAGSTAPSRVPEGGHMISASQGQSSKPMVGSIFRPPSQTAPKAAPFQLQNSHSRYSQSQPQLHNTSSSISSSKPPLKTAIQTAPGQGQRPTPPPPPVSSSVFKPPHQPPRQPSSQVPPGISQSQPAGPDMPQPLASVTLPPQPQQQQQQQQQPQPQSRPQPQPQPQPQPQRSTSKFISAPVASSSSKVNSQEAPATQPPEAPNLTVQDIESKLQSFIATVGEDHARFVEYLLDEAEQMAPEPKHLSDFDAFADMPALSAPATTSDTASISDDGVETMAFKIKLHHGDNGKPRAPTKAFKCPVVKIKTDKEVVPKYRFHHTEIKKNILVPNTMLTFVPHLRDVDPDSVDERDYISWLNELEKLDTQSGFKTENRQQKNHKRVRDEFTATLSMYIEPWLKQLGLDVVCGRPTLIRYMLSQEENKAHITQQQKDVLLNTYKDDAILSPKAVEAARIFTLAFNNVFGNNTDPERFITLRDVLLLEKRETVVDEKRAKETPPPANPQRDQSDSNGLLPKVEASLSSYAVLGCNVCFSHDCEHGDIDAHNYHRTFSLDSVGGVIRALKRKWADQVASMGGDEEAVAAASKKALHLPCHNACYRHYDVGPAAAPVTPWANSEISVLEDMFVSVGHSQTLKAQCVVASILGRKCWEVYRKIKELDLSLPQVSPPRPKTGPKGGPPTKVKPLPWYDRRKKCLMGDWQDQTATHEHSIREITEPCHHDGPCTKENEACPCANASPRPLLCDRFCQCTVDECALKFTGCACHSTGKTCIQRQKEGKPCICIMLNRECDPVVCKGCGAKERADPDNAHDETLHSTGCQNVSLQRGASKTVLLGKSQLEGCGYGLFTAEDISQDEFVIEYTGELITHDEGVRREARRGEGFGSQGTSSYLFTLLEHEGIWVDAAMYGNLSRYINHASENDKKACNITPKIIYVNNEYRIKFTALRDIKAGEELFFNYGDNFPNLTKKLLEDQDGDGENDTATKSKGKRGSSSLAQGTARKATTKASTTAKGKAKTQGRARGARKTAVMEIPPSDDYEDQTWIRDPLPLYDEYDEDDDSYLPVGRKRRKRGGKRAGAGRKKKTPSPEEGEEEGEDHGSAGEDDAEAEAEAEGDEDGDGDANGPSNQQTRNRRTRAVSEISDSQAERDEDMDEMESEDSDAPLSPTRVTARRRRQLRTTAAQTTTTTTTTTAAINNNNNNNNNNNNNNNNNNNNNNNNNNNNNNNNNNNNNNNNNTSRATSASASASAYTTAASTSNSTPAPSQPGDGGGGGDGDDEAEGNQEEQEEEEEGQRKKRSNRGGARPGAGRKPRKMGRQQAASTSASVSASESTTAAGSHAGSYWDRLKSSIAFGSGSGSSSGPAQLANPHSGSLPANPSGISPSKSKRKSKSKKRKAPEAEIYSMAEYSSSGFGSGSDAELFSAPESKGDHASPSKKKKQKTTSTSTSTSTTTTAANRTRTRTTRSSRSARATAAKTTTSPATMKIKPLGVTVTRSPGGRGTAARHTSMHNAAAEAQLRAEQSLRDEAAAAAAAAAAAGGASNAQPQRALQGQVQGQEMQATQGQGQQMQGSTSSGLYHTAANFQPFTSDNDEDDGEEDGASVGSGEEEEEEEEEEEEDEEEEEEEEEEEEEEGEDGASLASGEEGEEEEGQNRKGLGSGEEDEEDEDDDEDEDGSEGDGGDLDVDVEHGDADAYTYTYAENDLLLSLSNEEEEGILGDYDSDGAASNPSGPESGSSNEGDESEDDDDNDDDDTGDREESKEEDQSPVKRLRPRHPHQASPPTKSMASKARPPVVGGKVLRQRSSQSQSQSQSQPHSQKSKITRQSSTATGTRSTERKITRSTNTSGTTSTRKPSNSNTNTNPKLKPKPSGPSKETRSSTAAASVQNQNPTRGSSSSLKRKKASGRAGSTGGGGDMEGTSHRKRQRPLRYRNEEE

SEQ ID NO: 23341 - protein, 395 aa, Neurospora crassa
MSHSKPAPLILSPHTRDVQDSDLSGKRNTSRPVFTSHERQLAKAAWTASSARLSRESFLPFASCSLCLETAIDPVACLHGDIFCRECALTNILAQKKEIKRAEKLREQEEKEAAEEQARRDAEAQERAIREFELTQAGLSIQRGNSNGDDQRDITLPKTESTSIKNGDEKRIEEKRGEKRKFSLDGDEVARIAEEERAKARRAIEDEKASKPKLPSFWSPSVTPSSNSKDILHDIKKKVKTQPTCPAAPEDRPHFYSLHTLVAINFTEEEDSSTKTKARICPACKKALSNSSRATLAKPCGHVLCKNCVDRFMKPMGHHDPHAPDVDPDAIVCYVCDTELTEKKESSSKKGKEGKKGKKEKETIKPGLVELRREGTGFSAGGTNQVKKDGVGFAC

SEQ ID NO: 23342 - protein, 337 aa, Neurospora crassa
MDGRKHPSSFQQLEKLGEGTYATVFKGRNRQTGELVALKEIHLDSEEGTPSTAIREISLMKELKHENIVALHDVIHTENKLMLVFEYMDGDLKKFMDTNGERGALKPHVIKSFMHQLLKGIDFCHKNRVLHRDLKPQNLLINSKGALKLGDFGLARAFGIPVNTFSNEVVTLWYRAPDVLLGSRTYNTSIDIWSAGCIMAEMFTGRPLFPGTTNEDQIVRIFRIMGTPTERTWPGLTSFPEYKPNWQMYATQSLSSILPQIDRDGIDLLQRMLQLRPELRISAHDALQHHWFNDLVHQQHHHQAQQSMMQQPPMMQQQPMMQQHRGYGQPQPNYEGY

SEQ ID NO: 23343 - protein, 1817 aa, Neurospora crassa
MSSHDKNGRATSSSGKASSFFSRATGKNKADKRNASDEGGRYLAADNDAASTHTARSSRHYRDSSVISLDRPDTPESGLNMTAGVVTTIPYDPVSPDNRSPVALDHLPRPDQMPLRRELVPHHLNKGTGDFHQYPTIDQSPSSPYNGQSPSASSSRSTLATANITMASTGRQAQFQQWGPPRESSLPGYNSRGHSYMTTRSSGDNASIYSGRDGHYQEAPGTSHRSSRIGLPSTSSQSSYLSPHAHKDRDTQRLTKVAAGHQGSEGFNFPKPDDDNVIEQMFINLMQKRGWHNLPDQAKRQMIAYPAAKKWTLIYQDRLTEWQGEQKRRQTAKIGQYSNVDITQSSDDEGSPEWYVRKVMENALDSKGLGGLEVNLRTQQIGWVKRFIDCQGQIALTNVLLKMNRKTAYGPAQPDNGRLDKNLDREYDIVKCLKALMNNKFGADDALAHQQVIVALATSLISPRLTTRKLVSEVLTFLCHWGEGKGHVKVIEAMDVVKAQQGENGRFDAWMRLVEVTVDGRGKMGSLVGASEEVRSGGIGMENLLMEYAVATLILVNMLVDAPEKDLQLRIHIRAQFTACGIRRILNKMEAFQYELIDKQIERFRSNEAIDYEDMLERENSSIKDSIEGEVKDLNDPVQIVDAIQQRLNGTKTQDYFVSALQHLLLIRDNDGEERLRMFQLVDSMLSYVAMDRRLPDMDLKQSLNFTVQSLLDKLHTDSEARQALDEALEARQIADAAMAERDEMKERLALGADGLVAKLQKQIDEQAMFIEAQKRRAEGLKSELASLQTLRAKEAQRYELETRELYLMLRDAQDVAASNATKGNAKLGEEDVARMQGILDRERLLERLQMQIERQKTQFKLEGRVWGEVIGPSDRLRALREEMDGFGDDTPEVVPPKDFTNSMLGSVKRSTRIPRKPVGSRSDHVEDVLEESDVEIGDDGEIVYEKPRVVKIRRPVVDPKQTNGMFNELTGKVRRYDASDSEEGDGITTGPSHPSMESQTPITPSDTETPKIQVTDATGPSAPAAASGPPPPPPPPPPPPPPPGFLPGAPAPIPGAGGPPPPPPPPPPPPPPPGGLPGAAPPMPGAGGPPPPPPPPPPPPMPGMAGMPPPPPPPPPMPGMPGMPPPPPPPMPGPASGRFLAQNAGLPTTNSVGLPVVRPKKKLKAFHWDKVDTPLATHWAAHTPSPESREEKYHELSKKGILDEVEKLFMAKEIKKLGGGGAKKDDKKQIISNDLRKAFEIALAKFSQFPVEKVVQMIIHCDKDVLDNPVVMDFLQKDDLCNISDNTAKVMAPYSKDWTGPDAGKDTREQDPNELTRQDQIYLYTAFELHHYWKSRMRALALTRSFEQEYEEITEKMRAVVAVSESLRDSVSLMNVLGLILDIGNYMNDANKQARGFKLSSLARLGMVKDDKNESTLADLVERIVRQQYPEWEDFAKDIEGVIAAQKINIEQLQADAKRYIDNIKNVQMSLDSGNLSDPKKFHPQDRVSQIVQRVMKDARFKAEQMQLYLEEMVRTYNDIMVFYGEDPSDDNARREFFSKLASFITEWKRSREKNIQLEEQRKRNEASMKRKNAQFKALQASEAQGPASPTSTGAMDSLLEKLRAAAPQTRDQRDRRRRARLKDRHQVRIASGQQVPDFNEIPEVEAALQTGKSAASATTDDDGAGNGLVSPDALPPTKEAPDAEEDDVARRAAALLQSFQGGDGAEDDAEKRESLRKSRRQTAAEERNMRRRRREKAQTSTAGEEGKDESTAADGSEAAPSASAEDLSAAEAKTDGPSSPRPGTATGAEASEETETTPTATATDTNPEESKETTG

SEQ ID NO: 23344 - protein, 418 aa, Neurospora crassa
MADDVETQAEKAQPVTRSIHPVFYIASWIFFSNITILFNKWLLAPHRFSYPTILTCWHLIFATIATQVLARTTTLLDGRKSVKMTGRLYLRAIVPIGFLFSGSLVCSNMVYLYLSVAFIQMLKAAAPVAVLLTAWVWGVEQPSQSRLINVLFIVFGVGLASFGEIAFSLTGFLFQLGGIVFEAMRLIMIQVLLKGDGQKMDPLVSLYYFAPVCASMNFVVALFTEFRSFNIADLYNTGLWCLLLNAVVAFMLNISSVCLIGRTSGLVMTLTGILKNILLVVASVMIWQTSITPLQFLGYAIALAGLVYYSLGRDQIVEITTQFWTFLRGVWENSPAYSSVSSSSSDEGNGQQQGGGLPSAVRRALLMGLGVMVVVILAAGYIYSGADPSGGGAAVGVPRPLGGGGGDASSVKPVPVAS

SEQ ID NO: 23345 - protein, 145 aa, Neurospora crassa
MPDFGEHVDNGIFEQILEMDDDDKREFSKSLVTNFFDQAEETFVKIEEVLNNEKLDNGKRLETLSSLGHFLKGSSATLGFNKIRDSCQIIQQYGHKLTVDGAAEPNEQVCLEKIQAALKTARNDKNVLADMMLNETHGFFQPDDE

SEQ ID NO: 23346 - protein, 355 aa, Neurospora crassa
MAANYWESTQRKHWLFTKDELAAMRAKLEAEEPNLVASFPLPQLRHLNIYFNQQSPTYFCFTLEINRLGKRMGLRQQALATAQVYIKRFYTKVEIRRTNPHHVLVTALYLACKMEECPQHIRLMANEARGFWPTDFQSQTEVARIGECEFYLISEMSSHLIVHSPYRTLTSLQGELGLAQEDVNLAWSVINDHYMTDLPLLHPPHVIALTAILLALVLRQDPSGRLPGTAASASGLVAASAALAQAQAQAQARAAMMAGGGQTVPGLTPQSSSGLQAMLPPQSPAGEGPAEGNKNPRMAKVHRFAAWLSDSNIDIEAMVDCTQELISFYECHEQYNDKNTREQINRFVKARGLDK

SEQ ID NO: 23347 - protein, 107 aa, Neurospora crassa
MTRISSSGGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 23348 - protein, 521 aa, Neurospora crassa
MLNYCKDKGLDFLAIRDRLNLDFYGLIKLINFIRSKVHEGVPLPAEITAADLEDDRYLKPVLDDDALILCLDDLPESSGTGAEASAAGTQKGADAPAVDELIQKNAELQAQLEQLSKQFSNYRLAVQQTLDQRWQADDDDKDAAKGKAAAAAAAAAPSGPAPEGPAAKEGASDYYFESYAHNDIHETMLKDTVRTEAYRDFIYQNKDLFAGKVVLDIGCGTGILSMFCAKAGAKQVIAVDRSEIIDKARENIYANGLSDVIVTLKGRIEEVILPVEKVDIIVSEWMGYCLLYEAMLNSVLWARDKYLAPQGLLVPSHGNMWIAPVSEQEYIAEYVDFWRDVYGFDMKVMQKGIYEDCRMEVRPAETVCGTPASFGLLDFHTVKVEDLVFTAKWQSAFDDKAESHDGFLVWWDVFFARNRVDESIKLDTKAQEWVAETAGKGGDKDARVAFTTGPFGEPTHWRQGLMLLDKNKVKETKPAPGKKIAGEIEYITAENHERGLNLRVTWAAEGEKEQTQTWLLH

SEQ ID NO: 23349 - protein, 537 aa, Neurospora crassa
MAMSTVAAALGKLLFVAVVTLVISVANALSSVPELSDWEQDQYLTLQLTVPLGSGDAKPIRHRVVPLTEAVGMNQSVIARESITIKGTMVPTEESGWLEFIDSNSIAYLNCDNSNSTSFFDQLMSKAPKAILLFSLAGAGCRRDSTDDWNYTTLFTMTDQIDARDTLNLTMSGSLATITGDYEEPDDDDDEDRTGHGSPIAMNILYSITGVITLLFLAIIATGAIRAHRYPERYGPRPGYGGRPSQSRAKGLARAVLETLPIVKFGEKSPAKPDPDFQLEQQPSRSSQDPTPRAKLSAIQEAVPSIAKSQGPMTVASVEASEQASSATVYGAQTGMTNTAGDIENTTPDDINLGCPICTEDFTIGEDVRVLPCNHRYHPACVDPWLVNISGTCPLCRLDLRPHSSTESTTGPGDNHSVSLPTAAGDNAQQPGTSGSPMPSTTPRERRRSLRILDLHRLRAASIEERMEILRRHRSQQQQRRHVTGSSLTGDPDTGESADPTHRARLAERFRGRFRASRPPGQAQPQPTEVDIPTPTP

SEQ ID NO: 23350 - protein, 322 aa, Neurospora crassa
MNSATSNFEVDATGVSPKQIHNLIPSLKLSDGNEIPMLGYGLGTANYKSGDSADTISEPIVNATLTALNAGYAHLDGAEVYGNEVELGRAIAQSKLPRSSLYITTKTIVRAGDTVTQSFNRSLEKLGLDYVDLYLLHSPFFAKNPEQLQAAWREMEKIKDSGMAKSIGVSNFLISHLQTLFDIPGGLQYPPVVNQIEYHPYLQHVVEGEDLVAFCREKHIAIAAYSPLTAITKARPGPVDPIYTQLAKKYGVSEAEIAFRWCLDQGIVTLTTSSNEERLKGYLKKLPSFKLTPKEVEDIASAGKEKHYRVWWTEEFAGDDRH

SEQ ID NO: 23351 - protein, 2476 aa, Neurospora crassa
MESVAIPPQDDQQQLDPPARIFERLRQIAGFAWDETKPPYHSTYDNWHVFGTRFVSPFSTTGTPAPASPAPYPNTSPSSLAKLAPGHRAAPQDRPNVSASHSDAGSDRSTISLPTVAHHATDAPVVEELVVARISYHVLREERAYHITKSLVSTVDPNAEHISRPIDLIRLNPLPGDRGTIVVAIYAYSGENYLFKVLDMGPAFFYAKKHNDRWEAHREEHPVLEEPISLQHFLDFAIGAAQCLEMLHHSQSIVHGEIRPDAFHYNLELNRIKITSLGSGLRSFEHGLTSTGWSTLSKEVGARHKLQYISPEQTGRMPAEPDTRTDIYSLGVLFWSLLTQQPVFQGDTPLDIVQGVLGRRIPNVSQIRMDVPDAIGRIIQKCISKNVSDRYFSASGLRHDLVKVQELLGSGDSQSLRDFQVGSRDVSSSFRLPTIMIGRDRERSELVKVIERVSKSHGMNHKGGVNWGSDGSVLSNDVVDNAEVSSEGASSADGLNRQSGSWALALTPDPRNRVSLPPSALGTSSVTTSGETTSSGTSTGTSTISGGNRQSRQWDKPAFETSSLNENVSSDASRGSGLLSEPTSTISRQLGSKFRKQRQGNCEVVIIEGTGGLGKSYLVQSILADARRRGYCATAKFETARRTAFGPLLQLLSSLFRQVWGERNTETPFHQALKHHVRPVWPTLHKVLGLPEFLLGPPDNTPQRSNSTSSQSGQPALKRRGSSPELGGNNMYRHSSKVSSATQTSQEFLRAGASTQTSRLTNTFLDVLRMFTHYKFICFCLDDLHFADDESQELISQIIGARMKMVIIITYRPEEIGPEKVLQILSPPKSEELPRGAGAPIMTKIKLTPLSEDDIIHFVSSTLCLPKEDVTPLALVIQSKTAGNPFYMREMLNAGYRKKCIWYDYMAGEWKYDLDKLFDQFQGEQNYDVLDTAFITRRLSELPPASRSILAWAALLGQTFSFDLICRLMTGEFHFEEDKDKRQQEEDCSYIIPADESVAGLEAAIQACIIVPSDRDDHFRFVHDRYIQAAAALQECNARKMHFAIAQTLLKYHANDRTYRDNAASHICECVDIICQQVSRRRSYRALLSRCAQEASVSGARPTAAKFYGNAVALLQPDPWNDDAGDSSYEETLQLYIQAAECYLYMGLHAAANDLLQTILAKARTAVDKAPAWVLQSRIFAQRGNSEQALDSLRLCLKALGVGFDDNPSFEKCDAQFERLSVRIQTMDRSELVNPPKTEDLTLASLGAVLTETVSAGWWSNCLYFYQLALSMMELHLEKGSFPQSGMAFLFLGTIALSRFNMVQFTVDLAGIFLELLEKYRDPYSMARGYMIYANFVGHVQFPLGAIANQLEASVEFAAAMGDRISAILSFGLAAQLKFFASENISDLEAFCQYGCEEVPNWHLDTRGGVILIAIRQVCRALQGKTQVTDPYEVMSDEQHKASTYKSWLTAKASGDRTLMFYESIEIIPLFLYGHYERAIEIGEVCCKNSKMIWSARNTKLAQWFYALSLAAVILREQQDPRRMAEDEEKFQSRVEETIEKIDELNKGLKDWQAVNNVNYLAWSKLLDAQIAEIRGQYGDAIQQYEEALDHAAEYNFLFEEALGNYLMASVFIRHKGRRSARSTLRDSIALYRQLGATGIADLIETGHSILLHGPMRNPRTADAGVQTDFTGDAASVQYRTVEEEGLEDGEETAQAAVAALKGERMTAWRGSMQPEAGVGLPALDMIDLHAILVSSQVISSVLRVDELLKTMCDVILQTCSGSATLAALVVYEDEKQKDNSPLCVAASGDPDKGAEAHIPGIPLSGTDLVAENVILYCSRFREVVFLRDLVSDERFGNVSESWLRRNPNSKAVIAIPILHGSENPLLGVLYLEGVPGSFTDRNVTVLQLLVNQIGISYSNALAMKAVEKVSAENVSMVALQKRALAKAVEAETKARNAEAEAIRNVKLAEEAAKAKSIFLANVSHELRTPLNGVIGNSELLRDSNLNKEQLEMADSIRVSADLLLTVINDILDFSRMEADKMKLYIIAFNPEEMVREVVRAASYSNKEKTSKKNVKIVHDINLPPMLIYGDPIRLHQVLGNLIGNSLKFTEHGSITIGAKVDSETTEKATLTFWVKDTGIGISPQQLDKLFLPFSQADESTARKYGGSGLGLSICKSLIESTMKGKIRLDSEENVGTTVWFTVTFDKAKPEVMAGDTQSTSPVQMEPPRDRQPRPLPGAVENGDISSDQVPRPYIDLTHIPRNQLRICIAEDNSINAKIAMQYMHKLGYPNVDTYDNGLKAVEGLREKARQGNPYHIILMDVQMPVLDGYEATKMLRNDPIDSVRNVLVIAMTASAIQGDREKCLAAGMNDYLAKPVRGELLKRKLDTYLGASASMSFSTQRFLERRFAQRPGSPQPINPGSSSTKKDVDTPLSSPVPPPLADNTAASASTVKIGVGSAAASLREVAASNRRKQQQQQQQQQEVGQAFVLSIFVLQ

SEQ ID NO: 23352 - protein, 399 aa, Neurospora crassa
MGVEEKSRASGDSPRDAVLPTVNPEAQKAQPPKSAIHPAFYVSIWIAMSSSVILFNKWILSAKGFDFPVVLTTYHLAFSTIMTQILARYTTLLDGRKTVKMTGKVYLRAIVPIGFFFSLSLICGNLTYLYLSVSFIQMLKATTPVAVLLSGWALGVSQINMRVFLNVSVIVVGVVIASYGELEFVWLGVILQIAGVAFEALRLTMVQRLLSSAEFKMDPLVSLYYFAPICALMNGVVALFWEVPRLTMADVDRVGLFYFFLNGLCAFGLNVSVVFLIGKTSSLVLTLCGVLKDVLLVVASMVIYGSQVTLTQFFGYSIALGGMVYYKLGAETIKSYAGEAGRQWADFGNRRPVLRRISIILLSVFVVFSLLGGFAPNYAAGIDPTEYLNEAKSKIGMSA

SEQ ID NO: 23353 - protein, 2177 aa, Neurospora crassa
MRFFSLHRRSHSKEKEKEKEKEKEKRKSITLPLLRPRSTERPRTTESTLTSTTTTTPALTPTPTLTITDTTAATTPTITTAKPVTPPRTTTPPRTVIESPDSHCSNQYAIARSHTGPTDGYALNPPEASAPSEQLEHQDQMTGGANGRGGLGSLQLPTPHLRASNQHTLAPVVDDIRSRDSVRKPSRLSSEVSFNDSPFSEPTSEERDLQQVENGKRTVGESQRGKMDTSEAKRQLSQYRLHLAREMEKREIVAATENRLAIPGPARVSPIQEEASSPSPQLPQSGSEPTTTSTESGNTIRGGVTPGLTARTPSYPFPRMASSPGFPHSGLPFHRPFTTLSPTTFPTTHSSTGAHVSFAGIQGLDHSVSNPSTPASAMTFLPPGCSGTVQGEFATPNLYDLTLMLSAEPGLDAWWHTVVQIMTEVYRAERVTLAVPADPTDIENVPWGQKATYNPHQEDGLSLGYLARGSSFVHSSTDDITDLYQNNDESLKPKGLARPGLPSRHSFSSYEDSKDKKESIERTPVTPLRPPMASRSKTAHPGVGRDRDVSEDDDVAVSLNREALAEHDALEGQQPIPSWEAPITNKREGHGKLLNVLQALDYEADPLIDHNGVLRVLERGRVVALTRSYPYLTQTSSTDSKAADPRVATRSQSPEGPRKKIKKIRTRSESATKLSALLGSATLSTAAGRTSGGHGLEKKATGIASRLDDEYPRPPTPKYEEYEQAPPSPWSQSPAPSPAVRADPSENPFFADAMVDEESFNPGSAPPDYSALQPPEAIGVDNSWTVLHIPLTHVLLSKPQQPGFKLDSTFLEQKMSQRGKSSHTPTIPTPYQEPVAKEKHAPIAILSILSPIIPYPTNLRHSLEHLAPHLATSFSLCRHYTNLETELNGLQKRRPQTVGFGALGPDGRPLADPTAFTMGYLPTDDSISQQSHAGSITSPSEYSGPSRSVIHSPNGTPTWDSSALSYLMGKRSSSASPAPVAAGDSYFTTTPKPGGTGVGQRTKTGSRESTTLERKGSLKIPGGKSQWQDAAGVAPVSQESQGSGESNRRSIDEPSPTNSQQKTAVLKEQREERGGIASSQPVETQRRKPAGTPTGQHRHTQLHSYGADFATTFQSLPPSSTVGKGINQGATASRQGSISSTDMTPPSDKLKGLILDSLPAHVFVALPQTGEIVWVNSRFLTYRGQTSSDLAADPWGSIHPEDREEYLRKWSASVRTGEPLSETVRIRRFDGAYRWFQARAVASKDKRGVIMQFLGSYMDIHDKHVAQLRAARQEEIEVSEAKHRLLANLIPQIIFTATEDEGITFANEQWLSYTGQGFDDVLGLGFMDFVHPEDLAKCRIPLERPTSPHVRQDKTKHDHSPSPSKFGMAAMGKQPATPHAENVSGPVHPALTRHSSSTSSSANDLAGPNLSELARQGVIKISTDSKGQLSYTTEIRLRSKTGEYRWHLIRCVEIDNVDFGNGVSSYFGSATDINDLKLLETKLKEAMESKSRFLSNMSHEIRTPLIGISGMVSFLQDTTLNEEQRDYTNTIQTSANSLIMIINDILDLSKVDAGMMKLNYEWFHTRSLIEDVNELVSTMAIAKRLELNYVVEEDVPAWVKGDKVRIRQVLLNVIGNAIKFTNEGEVFSRCKVVVPNHGHLYENEIMLEFSIIDTGRGFTEEEAELIFKPFSQIDGSSTRQHGGSGLGLVISRQLVELHGGKMDGKAVLGKGSTFTFTARFGLPTESDNPDLAAPPAPTPGLIPEMNILRRSSMASPHSRPYLTSAPSSGSVVPVESDTRSPAAVSTGSSEPSIHSSRTRNTERSSISSVNVGSLARFSEAARASGHDLSQMKLEMPHGRGGGGSDAGTTPTPSNSSNERLSRPTIKEGGGSEDSDGYHTSLFSILIICPQTHSREATTKHIEMTLPKSNPHQITAVASVQEARKLIGGEDPVFFTHVVVNLPTPEQIIELMDEVQRSTMIGRGVTILILSDSVQRQAVLKQVAGTQYEDILSENRVTYIYKPVKPSRFAVIFDPAKERDLSIDRNRSTAEQLVENQKQSYLEVEKRMGNKGYKVLLVEDNLVNQKVLQKYLKKVGVDVELVADGVECTDVVFSRPHDYFSLILCDLHMPRKDGYQACREIREWEAKGNFPGRALPIIALSANVMSDVQDKCLQAGFNDYVTKPVDFINLSNALSRFF

SEQ ID NO: 23354 - protein, 301 aa, Neurospora crassa
MASNKTSMAGHLRKCHGDRFICRANDCMFAGSKGDVDSHLKEVHGYLGCPEAACDFVSRHEGALSRHYIKAHARRLRDEKCRANNCSFTGSKDEVKLHMKEVHKYLECPEAGCDYMGPNKIALHQHQKGIHGEKMHCPVAGCDWDGTARNFLHHKHKHGPTYKCPEPNCPVTHTAVLLKKHIRRAHARPTFTLEMVRKCEVARQAKDHEGLDWSIINDADEDEDDEDDEDDEDDEDDEEDGEDGDDEDDEEDEEDGDDEDDEEDEEDEEDEEDEEDEEDEEDEDDDEDDDEDDGDYDDTVR

SEQ ID NO: 23355 - protein, 364 aa, Neurospora crassa
MASMLEFRTPGYNPYAVKYSPYYDSRLAVATAANYGIVGNGRLFCLGLSAAGVQCEKTFETNDAQYDLAWSELNENQLIVACGDGSIKLFDLGVENFPVMNFHEHKRETFSVCWNPVTKDSFISSSWDGTVKVWSPTRNASLKTLPIGCCTYSTSYCPSNAALVSAVSADSSLRIFDLRTPVSAKYHLTNVIPVHAPATGGSGYSRLADGSIYSGTVPNEVLTHDWNKYNDTVIATAGVDRVIRTFDIRNPAGGPLALMTGHEYAVRRVAWSPHASDILVSASYDMSVRVWTDGSTMPQHVQPPVPSGRQPDTVRAGTQLGLMNRHTEFVTGVDWCLFGAGGWCASAGWDERVLLWDAASLLRG

SEQ ID NO: 23356 - protein, 724 aa, Neurospora crassa
MSSYQAIPPKKRSGAGLDFASSFRSASPLAQEVLARDLAEFSDDAVDEVDNEALSVSDNEDETSGPTLYRRPSGVAFGAIRPALAGPGGLEEAPILTRAERTRSRDEERSLLRDNHILPPKHDRPPQKPTLFRALYTRIFSTKVPRRISDEEVAASPIQIVIAPPTPTVTETEPLLGERSLRHRGAIGHGDEPSSHDHDHEHEHLNEQWEAAVAAGQIKTTWQREAKTIAVYSRSLIVTFLLQYSLNVTSIFAVGRLGTLELGAVSLATMTASITCYAPIQGLATSLDTLCAQAYGSGHKTLVGLQLQRMVYFLLLLLIPVAAIWLNAESILAAMIEKDSAKLAAQYLRVILLGTPAYAMFESGKRFVQAQGLFHATTYVLLIAAPANVLLNWLFVWKLGWGFIGAPLAVAVTQNMLPLLLLLYVWKVDGRQAWGGFRKAALKNWGPMVQLALPGMVMVVAEWFAFEILTLASGRIGVAHLAAQSVLVTVTSTTFQIPFPLSIAGSTRVANLIGAKLVDAAKTSAKVTIVGGVIVGLFNVTLLSVFRNQIALLFTQDPEVIELVAQTLPVCAIMQLFDGMAAVSHGLLRGIGRQEIGGYVNLIAYYVVALPLSFGLGFSLGWGLVGLWMGVTFGLLLFVYPSSFPPRRPPPFEQNTDLELIPYAGCLWLSIGSSGTPIGNWLPGRQKTEMPLVSSTRVSFNIQAFRAVPHAAIRTGAYHCVPRQ

SEQ ID NO: 23357 - protein, 500 aa, Neurospora crassa
MSKSTDSGVVTEGDLRGPSSSLKSSRHEYTSDSQTTELVQEQPKRSWRSYVWDTLDKSPQERRFLFKLDAVILTLASLGYFIKYLDQVNITNAFVSGMKEDLKLFGNELNYMQTCWTVGYVIGEIPSNILLTRIRPSIWIPACEVVWAILTILLAKCKTTTQVYVLRFFIGLAESVFYPGMQYIIGSWYRKDELAKRSCVFHASGAIGTMFSGYLMAAVHKKLAGVGGFKGWQWLFIIDTVISLPIAISGFFLMPDLPEITKAWYFSADEITLAKERMRLEGRAPRAPYTKAKFKKIFSSWHIYLLTALYIFFNNGNGASGQPAFQLWLKSKGHPITEVNTNPTITAAITVITTLIYAWTSDTVFRGARWPPIVFSGLVNIVIYSSLAAWNIPDGWKWACFFLAGFGGGISGLTFAWAHEICGDDNEERALVTGTMNEMAYVIQAWLPLLIWQQVEAPVYHKGYMTSIFIAVAMILTAVLVRFLHHKERARKLLAEEPNA

SEQ ID NO: 23358 - protein, 731 aa, Neurospora crassa
MRLTSVWTSVVQVFSFLTFSSPEDGNDLSSQRPQFPIPLENVHHHPPASHHPIPPSSNNAAEDVVPLYTSGSERSYMLKDHPVVGTPKSPQEGGPARRLDCHYPDMQDWEPCYGPENRTCWLKHKYEDKRIDIMTDYENEWEIPKGKVRKFYLEVSEQPIAPDGTTMEHGKVFNRTYPGPWLEVTVKNNLRWNGTSVHWHGFRQFESFHMDGVNGITECPIAPGDTFTYRFRAMQYGSAWYHSHYSLQYGDGLLGPITIYGPSTANFEADEAFRPLLLTDWNHRSVFEDWPLMLKSGVAPSMTNILINGVGQFGSGGKQKEKYTLYLDEGKKHLLILINTAVDTTFVFSIDNHTMEVIEMDFVPIVPYNTTNLKIGIGQRYHVLVHGLENPYEAERYGNYWMRVIPARKCSKFPYGPDEQMGIFRYNTTYQTMASAPDPMSEPPLYETNCADEPLDKLVPKIPWTVGNPVNIDPNIDPKKLPANESYIFNVGLTMSGGPNTSTPYIPDDQPYARWDMHIAPFRINFSDPTLLSLSSLDSLITKPHLDIVTLPTSNPDDDKWIWMVITAPDKVPTEGARIFFPAAHPIHLHGHDFAVLRQSSKNWYDDPEIGHIGEGKRWFTPDKLNCENERLDCENPTRRDVVLLPASGYVVIAFKADNPGAWILHCHIAFHASSGLAMQIIENKDLIPAIMEKDKPVIEEKCRKWREWYGEPKNLWDWHEPKHFQDDSGV

SEQ ID NO: 23359 - protein, 449 aa, Neurospora crassa
MSAPAHKFKVADLSLAAFGRKEIELAENEMPGLMATRKKYAADQPLKGARIAGCLHMTIQTAVLIETLTALGAEVTWSSCNIFSTQDHAAAAIAAAGVPVFAWKGETEEEYQWCLEQQLIAFKDNKKLNLILDDGGDLTHLVHTKYPEMLEDCFGVSEETTTGVHHLYRMLKEGKLLVPAINVNDSVTKSKFDNLYGCRESLVDGIKRATDVMIAGKIAVVAGFGDVGKGCAMALSGMGARVIVTEVDPINALQAAMAGYQVTTMEKAAPLGQIFVTTTGCRDILVGKHFEVMPNDAIVCNIGHFDVEIDVAWLKANAASVQNIKPQVDRFLMKNGRHIILLAEGRLVNLGCATGHSSFVMSCSFTNQVLAQIMLYKANDEAFSNKYVEFGKSGKLEKKVYVLPKILDEEVARLHLDHCNVELTQLSDVQAEYLGLATEGPYKSDHYRY

SEQ ID NO: 23360 - protein, 1106 aa, Neurospora crassa
MVDMLGTNANVLQSRDPISEFLQLLQDPFAAQLSSNSIYAALGSSVSITVAVALGFSLVRPLNTVVYAPKLKHADDKHAPPQLGKGFFSWIKPLWTTTEQDLVRLVGMDATIFMRFTRMCRNIFLCLAVLCCCIQIPINWYKNAAPESPWLQKVTPMNVWNQWQWATVVMSWVTTLIVCFFLWWNYRKVCELRIQYLRSEEYQQSLHARTLMLYDIPKNLTSDEGIARIIDSVAPSSSFSRTAVARDVKILPTLIEEHEKTVRKLEQVLAKYLKDPKNLPVTRPVCRPSKKDPSFSTYPKDKKLDAIDYLTQRIKLLELEIKEVRQRIDKRGSMPYGFASYSDISEAHAIAYLCRSKKPQGARVTLAPKPNDIVWENMPLSSASRATRRLWNNLWITVLTVVWVAPNAMIAIFLVNLSNLARVWPDFQKSLETNRNFWAIVQGIASPALTSLVYMVLPIIFRRLSMKAGDMTKTGRERHVVAKLYSFFVFNNLFVFSLFSALWSFGATVIKNTATDDDAWQAILDADFGTTVFVSLCGISPFWVVWLIQRQLGAAIDLSQLWKLIYGSIMRKFTNPTPRELIELTAPPPFDYASYYNYFLFYATAALCYAPIMPLVLPAAGMYFAIDVALKKYLLMYVFVTKTESGGMFWRILFNRILFGLMLSHLIVFLVVWVRGFGYKTQAYAVVPLPILIIIFKFVCSWIYDNKITYFSTRIIKHRNAEEGFGLKEQGPRNDRLASRFGHPALYKPLITPMVHAKAQNILASVYQGRLSDGRDAGLGDSMSVSGYSDTYALDSMASGKVGKLSSAVPGFEVVPESRLDFEFYKNRDEFAADHGAGELFGRASDIVRPDTPGTMATGSDNNSRPGTPVGGMGFSHNRRFFSNQSDMGNTAYVGGYMSPSQQYSSNNQAPYSPPILGPSEVPGRGRSPLYHMGDNGNDSSSNLVYNAAGMPTSTPAGFEVADDGLHRERSFDSTRSRGALGGFSIPNPRAPGVLGASRYGYGNVPQTDDDMMQTPPNAIQSSHFQPNQGQNDPMQYDYFRGNRRQGPPPGAPGRGKPRRTVNEVVELSTLNKGKKRDILRFWVRKTTAESEHERLASSAPGDEEN

SEQ ID NO: 23361 - protein, 965 aa, Neurospora crassa
MSSSAADPFAARLNSDVRQRHPTASATSKNVEGTSQQKQQQQQQQSEANAAASRVKKTYGKTPDGTVFVVPTTHDMVTQLLDPREPKNLSDVAVLAIIALHFLAAYYLPWGVKRPLFAAIFMFWRLAYNVGIGYLLTIQSKYKLLVTWAKRWKLFENPATGKNPRPWLYNLLKKELETKIPQDYKFEEAPIEYNTWLTFRRVVDLILMCDFISYCLFAIVCAHKPDGEGLFMCFARWAAGITLVGFNLWVKLDAHRVVKDYAWYWGDFFYLIEQELTFDGVFELAPHPMYSIGYAGYYGISMMAASYDVLFISIIAHAAQFAFLVIVENPHIEKTYNPPQPRVRCESEAGSQLQEFASEYSVPSTTGRHDNTPLPVHNLIGLKNLDFFRITDVAIVLLCAYLAVVTMVTPNTRFYQALFVLHALAWRLWYSAGLGVILTMQSEEKMFTRHFLKYGESVGEAWRQWKGIYHLSNCLCHASFIAASYKMYEFPADWTYGWALLKHVVGLSLIALQVWTATSIYESLGEFGWFYGDFFFDSKRQLTYTSIYRFLNNPERVFGTAGLWGAALITWSRAIFLMALAGHFLTLAFLAYVEKPHMQKVYGRNLRDDAGVTKFIKRSLPPPVTEWQQSIDKVLDETKHFIDEFVDAARSRLATGSSTIVKDTSALFNKYPARLTLSKISPDLAGYDPKHYGLSLAGTRVVGTNEKATGKESPNARVLKDVKTQAFEYGAPIRVKWTAPANHSKKDWVGLYMVTDNRSREVTEVPSLGRWVPTNPGEYDTTTDQGILVWDQPVEKKSEDTDLVEGEMVFEGDKLWWTQGVFEFRYHHGGGHHVMSISEPFEIQIPKFDDEHMGVDISGEVGERAVEAALLPVIRNCLDRDPDIAPSNAEERFGGHVERDGKYARRVVYAIRHMFGIDFAPAVVLADGNVRRLAWRICHAKEVLAPFSMSHTNGRTTPVDSKFSE

SEQ ID NO: 23362 - protein, 299 aa, Neurospora crassa
MVGTHNLQASKLFNVDGWACLVTGGGTGIGLMNAQALAANGARVYITGRRYGVLVNAAKEHSPKEGNGKIIPIGPCDVTNKESLESLVHKFSSLEPHLNLLVCNAGISGPKADPSVSSSAKDIAHELWTKENFSDWSSVFTTNVSSVYFTTIAFLPLLQACSAAHPEGHNHMAGNVIVISSMSGIMRNAQKHFAYNASKGATVHLTKLMSTEFEKTGVRVNSIAPGYFPSEMTTGDSDEKNKSELSDDKVKGHGHKVPAQRAGHDEEMAMAVLFLAKDRYVNGSVICVDGGVLGVVPGN

SEQ ID NO: 23363 - protein, 1305 aa, Neurospora crassa
MATTTALPTLATAVTTAVSTASISGSVLSTISSALASTITTSASLTSSSSSTSSRVLTTTTSVPPKQVPNTDAAGSAQKFGGISLVAFLTALATSLVVFGVQMGLFLLLRHKLARIFKPKTYLVPERERTEPPPASPWNLLSTVLRYNDREIIKKCGLDAYFFLRYLQTLLVLFIPIAIVVIPILIPINYVGGLGHQVVDTNTTDTDDSDVPTGLDTLAWGNVRPEHYRRRWAHLILALLVIIWVCGVFFAELRVYVKIRQDYLTSAEHRLRASANTVLVSSIPDKWLTEDALRGLFDVFPGGIRNVWLTRDFTKLLEKIHRRDAIHVQLEEAETELIREAKRRQLKQRSLEEKRIRKAHQVKAESKKERKHRAKAEDDEAKRRAEDNGGLSVGDDDAVPHDVATAVHGGEKLEGKGLGDIQEGESEGSPHHGPRGGNGLFKVGENLGRGLRKGVGFVEETGHNILVLPKALQHNVEGELERTGGFDFIKDGAQSSPTSSTSSEYDSKLHPGDDDAQPKPSFASETPLQASQARHAHTLSEATQASTVQKGPDTRTIGNTTRKVSNVNDMYVTEKTRWYEFWKPPSGGYVSPVPQGYEREDYPWKVERTKWQKFKAAIPFYHSDIEDVEYPPAFTKDYTTEKEEGAEWQKWLSAKDRPHHRLALFDWTPGWLPALPLLNKKVDTIYWCRAELAKLNLEIEEDQQHPERYPIMNSAFIQFNHQVAAHMACQSVTYHIPKQMAPRTVEISPNDVIWDNMAIKWWHEWARSALVFAVVTGMLVLWAFPVAWTASLAQLDALVEKYSWLHWLVENKTIHNVIKGVAGVLPAAVLAILLILVPIALDWLATFQGAKTGSQTTETVQTYYFAFLFVQVFLVVSITSSTFQTIANITQDITSTPEVLAENLPKAANYFFSYMILQALSTSSGTLLQIGTLFMWYIMARILDNTARAKWTRNTQLPSVTWGSFFPVYTNFACIALIYSVVAPLISIFAIITFALLWCAHRYNMLYVTRFRTDTGGVLYPRAINQTFTGLYVMELCLIGLFFLAVDENDQVACVPQAIIMIIALIFTILYQYLLNRSFGPLLRYLPITFEDEAVIRDEAFQRAQERRLGIIRDDDEATALNRSGPGASDGKDIELRNLHKRTKSEADSLSRLGKLNPVRGIVQAGSWAARGGRQVRQAAFGKAEENLRTATIYRNERRQKDIEAQRAIGDALFGGYHDEIEDLTPEERDVLVRKAFQHYALRARRPTVWIPRDDIGVSDDEIKRTQEFSKYIWISNEGTALDSKVRVVYGRNPPDFSEVDIINL

SEQ ID NO: 23364 - protein, 326 aa, Neurospora crassa
MSTGTKSASAASHAELNRNSLFNLAGRVALVTGGGTGIGLMATQALAVNGAKVYIAGRNKEKLDKVVEIYNKDVEGEIIALQADVTKKEDIAALVKEIESREKCLCILVNNAGISSSSVTTEASDPKELKHNLFDNENATFDDWTETYRTNVASIYFMTSAFLPLLQASTERHPGWSGTVVNISSISGQVKSAQHHFSYNASKAAAVHLNRMLAAEIANAGLKIRINSIAPGVFPSEMTAEESDEFQKSHIPKEKYQDKFPSARPGRDIDMAQAVLALVSNQFINGETLAVDAGCLVPMCGSVPQGQNIRLGAGWRSIDPALRCKV

SEQ ID NO: 23365 - protein, 447 aa, Neurospora crassa
MLLDVKASQRLDSRGNPTIQVEVRTAHGIFRALVPSGASTGVHEAVELRDNDKRKYGGKGVLTAVNNVNEIIGPALVKEGYSSRRDLKQIDGFMRELDGTPNKAKLGANAILGVSMACARAGAAAANIPLYEFLRREGGEEAPYMVPVPFFNVLNGGRHSGNGMAFQEFMIAPTGAKTIEEGIQMASETYFVLKQMISDKFGAIYTGVGDEGGFAPPITQPEEALDLLTEAVAKAGYTDKIKFGIDAASSEFFNPENGTYDLGFKRIKEGESHSDDVRTPAEMMALYKSLIEKYPIPLLEDPFAEDDWESWTKFCKDFYFEELVGDDLLVTNVERVRMAESRVACNAMLLKINQIGTVTEALDAAKLAKSLGWGVFVSHRSGETTDDFIADLSVGLCTGHIKSGAPCRGERVAKYNRLLDIETELKESWKPWSYAGEKFRKPEAFFI

SEQ ID NO: 23366 - protein, 674 aa, Neurospora crassa
MAYTFLDAVAATGQRISAFFQTVTIFLLDHTLRPAFSLFSSNFNIPLLEGPPPQQTAAGEEQQEHPRPELRQFQQQQQQPSHQLDIQDQDSVTATPATTSQSQFKNQSEDASATNLNALPQVSFLSLTPEQANSSQLPDTEPDMARTSSATATLAPEQQPLKKIPVPNILPALPLVAPAKENAAPVKAGSTVAASVDSENNLTGDLGRLSIATDAAAVAATGVVGSGDRVLATQQPLDNTTPAAAADGANDAEPRQHLTTNVFHGHGPSTSVGWNIVDSLPRAPVVRSPAVPINHELSQTSQLKEGFTDSAAQLEAELETPEEAAERAMHAGFMREALDMARLALKTNETPVGCVLVYKDRVIARGMNATNVSRNGTRHAELMAICALLSYSGDADLEPKNVQPQCNHDEPSVWGDVDPRDGHLFPYGQKLHPAPRVDRSVISECTLYVTVEPCVMCASLLRQLRIKKVYFGAVNDKFGGTGGVFRIHKNSPFSMASAPPSPAPQNGKGIARPALERRPVSALNIGTGGVEGQEPEPAGDDTDESKQNETVGEQPGRNTTSLFEPELHGDGGNVEPGYEVEGGWGRDEAVTLLRQFYVQENGRAPVPRKKEGRAARLAAMMERDGHAGGPMADAPAVAKPEENGTSVDGDAAAQEDEEDTEKTEDENSGNSSDA

SEQ ID NO: 23367 - protein, 265 aa, Neurospora crassa
MTSTTSVQNMFSLEGHTALITGATRGIGQAVAIALAEAGADILLVQRDETSTTTLQAIQSLGRHAQIYKADLSSPTDVSSLVPRILSDGHTIRILVNCAGIQRRHPSHLFPDSDFAEVMQVNLNAVFTLCRDVGAHMLGLDPHPVTRRKGSVINFASLLTFQGGLTVPAYAASKGAVGQLTKSFANEWTSKGVTVNAIAPGYIETEMNEALLKDEERLKSISARIPAGRWGSPEDFKGTAVYLASKASGYVSGHVLVVDGGWMGR

SEQ ID NO: 23368 - protein, 1167 aa, Neurospora crassa
MARSGKKSPAPPPAYAPAYAPPPAYEAVPTSAVVSKNKNNKNKSAKVKDDYASEGVQDNDPFLLPGSDFVLLTIITMLSAVVRLFRIYQPDSVVFDEVHFGGFASKYIKGKFFMDVHPPLAKLMITLFGWLAGFDGSFDFKEIGKDYVEPGVPYVAMRMFPAICGILLAPTMFLTLKAAGCRSTTAFMGACLIIFENGLLTQARLILLDSPLMIGTALTALGFTAFTNQQELGPGKAFTPSWWFWLVVTGLGLGITASIKWVGLFTIAWVGSLTLIQLWVVLGDHKHVSPRAFAKHFMARAFCLIVIPLTFYMAMFGIHFMCLTNPGDGDGFMSSEFQSTLNSKGMQDVPADVLMGSRVTIRHVNTQGGYLHSHPLMYPTGSKQQQITLYPHKDDNNIWLLENQTQPLGIDGQPINGTGAWDHLPETPYIKDGAILRLYHLPTHRRLHSHDVRPPVTEADWQNEVSAYGYEGFDGDANDFFRVEIVKKKSKSGVAQERLRTIDTKFKLVHIMTGCVLFSHKVKLPTWASEQQEVTCAKGGSLPNSLWYIEFNDHPQLGADAEKVNYRNPGFFGKFWELQKVMWKTNAGLVESHAWDSRPEAWPILRRGINFWGRQHRQVYLMGNPIIWWSATAAVVIYVLFKGIAILRWQRSCNDYANPIFKRFDYEVGTSVLGWALHYFPFYLMQRQLFLHHYFPALYFAIIAFCQVFDFVTARISLVKDKVIFNRLGAVLFLTLSMVVFWLFSPLAYGNPWTKAECNRVKLFSTWDFDCNTFLDSYDNYYGITPTSQTPSQTPVQGTLERPAVANAPPQAQKPIVNQEQQAAKQEPSANPVGQRVISRQEKIEYRDQDGNLLNAEQVEALKGKVEFKTKYETRTRVIDANGNEIQLGGSGMPKVVRAPKASQPVAPPHPDVQGVDQETPKIPAAEEVVPQAEMSVDGEKEAEEKVAKPASESNEATVSQDIEQSDDVRAAQEKIQKMVERIQKVANNVDNLKNNVAEKAGDKVDQVEEKAEQAVEKVQEVAEPVEEKAEQVVEKVQEVAEPAKEKAEQVVEKVQEVAEPAKEKAEQVVEKVQEVAEPAKEKAEEAAEKLAEKVEEATEQSKEKIESVADNVKEEVTEKAEQVQEKAQEAGEKAQEVVLEKIDQVKEMAEEVGEKAEAKTEAKDEL

SEQ ID NO: 23369 - protein, 1319 aa, Neurospora crassa
MPFITPGQLAFSAMQFLPVPILVLDSLKTVVLANESMGRLLGMPSDATGEGDDLSSTMDQLRGQTLSQVGIDLIQDGMPVWIAWEHFLDQIALEMGVGNSGGKEILKSVLQTDPDGDATPRQAELPPSASTSSPRSRSTSAQSGDGVCDGDAGNTTCRPSPNAVVDVVIVKRDIARSTYHTRARSESSTFHAQAKMIISVWQLSPQQTFFTLTFTNTDSKYVPPVGAKKLAGRRDVLDAAEKKYPYSINDPPSLTSSRDSRSRSPSFPLSPSAVAMSSSPFPPLGPPSHSSITSAPSMLQKITVMKDALLDKTQTPIIAMWKDGSVILPNKPARRLSYPDPVQGAPHEGFNLLSQWRMWTDDFSRQLETDEYPISLMIKSETPFESFRVGMLGPDDERLIFDVEGAVIRDEITGELLAGVITCRDITRIEHEISQIKAADEERFRLICETMPQLVWTAGPDGAHDFYNSRWYSYTGLSVEASLGGGWRTAFHPDDLAEADKRWQNSTRTGEPYVIEYRCRSKDGEWRWFLGRALPLKNKQTGEIEKWFGTCTDVHETMEAKLEAKRTRQQLRSVIAHSRMTMFAVDPNRKVTLLEGSLIWDALSPECGSSSWFIGKDVYEVFNNINQQLPDGQTPAFLQPLESILGGKSPVELQDHKFGRWYRTGFQPILRRDPLTGNSTEDFIEGVMGFIMDVTELKDRERDIEAQALEKRQLLANEAAAKEASRLKSQFLANMSHEIRTPITGVIGMAELLLDVELDAEQRELTENIFRSANALLTVINDILDFSKIESGRLDIEEVQFSLAVVIQEVGKMLSFTAERKSLAFNYEICSDIGIDLVVMGDPGRVRQIITNLATNSIKFTHEGHVKLHVSVEQETDDTIEVKFVIQDTGIGIEEEVLKRLFQPFSQGDPSTARKFGGTGLGLTISKNLLELMKGRMALASKKDEGTTATFWIPFKKPQKAQSITGPLSDRLQSETSVSCNCPAPADQESGALSGEQRSAWRQSSTSLSPTTSQEELSMPDRSKIFILVVEDNEINQQIAIRTIRKLGFQVAAAWNGKEALEYLSKASTGKTRKPDIILMDVQMPLIDGYLCTHLLRHHAPYRSYVRDVPIVAMTASAIQGDKEKCKRAGMDDYLSKPVKRTTLERMLLRWCTTKREELSPITSQCTESGEHCQSAGIPAVGLNEEPSELDLNAYDNVDDHEGSNLATPMGPGRVAEGMSPGGGAEIEQSPTAGYFSSGSGSGHGVPDATKPTGDPGEQTGLGQAEQLLDASSQHYPSQPSVADMTTSPASIERREGEALTEENLGKLQEEQNEELQSI

SEQ ID NO: 23370 - protein, 537 aa, Neurospora crassa
MALTYQQSKLVRDTIPALKEHGERITSIFYKTMLTDHPELNNYFNSVNQKNGRQPRALTAVILGFASNINHLSELVPKFERMCNKHCSLGIQPEHYEVVGKYLIQAFGEVLGPAMTPEVQTAWTKAYWMLAKMLIGREAQLYRDFESWPSWRPFKIDRIVNECDDLYTFYLVPQDGKRLPKFLPGQYVSVQIQVPGGNLQSRQYSLSEAWREDYYRITIRRDEGTVYSNSVSKSFFNPGIVSNYLIDQTTVGSILQVSHPAGEFFLDVHNTSTVPLVLISAGVGVTPMVSIANTVMESQPSRQIAWIHGCRKHIPFEDHIKTLRKKNSNFQTKIFKTVINSTDRPGETYDYNERMDLAKLKPEELHLQHGGTEYFICGPEQFMVNQKLYLMQQGVSASRIKCEIFTTGDLKLGLIIETIDQEEEAGDEKRVTHISREGGGGWENVAPDPRKARRSPSLSTKLPKRRNHAAVSGLSTGSGTQKLAPTLLNPSSTRTRRDMTIPPPTTTTAMPGMEEEEEEERREEERRYRWREASALG

SEQ ID NO: 23371 - protein, 416 aa, Neurospora crassa
MVTSRHNDETFFVESDDQPAPRVNVRDAAKLIARNKQEMIANNLSRLACDEYLEDIMQHIRHMEDETLPDANLIDMQREIQWFMRPYLIDFLIEAHAAFSLLPETLFLTVNLLDRYCSKRVVYKQHYQLVGCAALLIAAKYGDKKDRVPQINELNNMCCGLYDAGMFTQMEMHVLNTLDWNIGHPTVDFFTQLIVAEERDSRDVEHMAAYICEIALYHRDFVSTKPSIMARVSLVLARAILGKPEVNDGEWDQVENATLLALSQHLHQPSVTLSRKYSSAYLSKVSGKLADFLAQQAAINRRGGAPPSSPGELTPNSSKASNVYSTPHKGLGAVPGAADGYMTPPITPDAASFAQNGTMMKEYPAPRCPVTPTPQPNSHSQSYPPAAQHQTSASSTSSSTKAPSYFETAPSSQVTY

SEQ ID NO: 23372 - protein, 371 aa, Neurospora crassa
MATRAVPRALRASNIFSTAARPTIQTILPSSQRAFHISAIRLQKKKKNTTTTTPGAGAFARTDDSITVEYPEDPSKLPSSQPVDSGIGRAGQNVFPTLATFSLQGKVGVVTGGARGLGLVMGQGIVVSGGDLAIVDLNKEEATKQAQNIVETFKKDYPSAKKIPKVTAHYADVSDPASVDACIAEIVAEHGKIDNLVTSAGFTENFEAVNYPVDRLRKLWGVNVDGTYLFATAIARHLMDRNSPGSLVFIGSMSGSIVNVPQPQTPYNASKAAVRHLAASFAVEWAKAGIRVNCISPGYMLTALTKKILDENPDLKEKWTSLIPQGQMGNPEDLMGPVTFLLSDASRYVTGADLRVDGGYTCTYLGMFYCG

SEQ ID NO: 23373 - protein, 322 aa, Neurospora crassa
MVPAIKLNSGFDMPQVGFGLWKVDGSIASDVVYNAIKAGYRLFDGACDYGNEVECGQGVARAIKEGIVKREELFIVSKLWNTFHDGDRVEPIVRKQLADWGLEYFDLYLIHFPVALEYVDPSVRYPPGWHFDGKSEIRPSKATIQETWTAMESLVEKGLSKSIGVSNFQAQLLYDLLRYAKVRPATLQIEHHPYLVQQNLLNLAKAEGIAVTAYSSFGPASFREFNMEHAQKLQPLLEDPTIKAIGDKYNKDPAQVLLRWATQRGLAIIPKSSREATMKSNLNSLDFDLSEEDIKTISGFDRGIRFNQPTNYFSAENLWIFG

SEQ ID NO: 23374 - protein, 787 aa, Neurospora crassa
MSSPNPRKRPAPGASPVVPLPLQQMPQQFTPGPADQVFRWNNPPDAAAAPLNSFGMISTQAPFPQPIPAPSTALARRPPSRALVTTNQFNGTTDTWASFSDDAAYPLGHNVPPMDEHDNIERLEEMAQRAKREAQAKRKQIPPFVQKLSSFLDESRNTDLIRWSDKGDSFIVLDEDEFAKTLIPELFKHNNYASFVRQLNMYGFHKRVGLSDNSMKASERKNKSPSEYYNPYFRRGHPNLLWLINKPKSGGKGNKPNKTTPKAEGEADSEEDAGGEDPYAGQNYSSAQVGRGSSGAGEVGPLHKKDLVAVKSQLDRLQQQQVAISSLLQKIRAEHTTLFQQALTFQNQHERHENSINAILNFLANVFRKSLEEQGGTQSVQDLLASIIPNAQVHNQNQMPQANVVDLGGFVNHQVHNNTSMGTPKRQQRLLPPIPQQGVAKVHSLASSASPAPVHPQYQAQQMGSVTELFDTTPGDSPSSTFMKNKLQNNPQEGMMKLIQDTNAVSASGGVDLPDMATKTHVNALSNDQRNKMLSIMAGNLPSTNGSSPAPSPTVPAVPTPTATMPPVSTIPTVPVTTAAAPPTPVVPNHAAPNALSPALGSMPPPPPFPSYSHEELDALQRLQEEQASQIDRLTSLLGPLSPSGRIPGIDEHGNPNSAAGYFDSTDIEQYLNDNAFSDPAYEFSGLPGANGTGDGASDFNFNLDDGFDLTNPTHTGATPTPNGGTATTAGTSNTGGLSVPGGGFDSGRIFEHNSPVNTPSPSAATEEISKNDLESPERDPKRRRKG

SEQ ID NO: 23375 - protein, 450 aa, Oryctolagus cuniculus
NTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRATVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 23376 - protein, 518 aa, Oryctolagus cuniculus
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRATVASMMHRQETVECLRKFNARRKLKGAILTTMLVSRNFSAAKSLLNKKSDGGVKPQSNNKISLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 23377 - protein, 499 aa, Oryctolagus cuniculus
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWISHRATVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGEDAACIAYIRLTQYMDGSGMPKTMQSEETRVWHRRDGKWQNVHFHRSGSPTVPIKPPCIPNGKENYSGGTSLWQNI

SEQ ID NO: 23378 - protein, 342 aa, Neurospora crassa
MSPRTDFPPVRACLFDMDGLLLDTEDIYTLCVNELLRKHKKEKFPLPWSIKAQLQGRPGPAALDIFHNWADLPITREQYKEEYYALQAQKFKHTTALPGVEELLQKLGSTRYWDLKGDASATTNGATDKPAPKPHRVHIALATSSHEANFRMKTNHIQELFSVFETHRRVLGDDKRIPEGRGKPLPDIYLIALKTINDSLPEGEKPITPEECLVFEDSIPGVEAGRRAGMRVVWCPHPMLKKEVDKNGDAKLVLAGLLNQADIEKKKAQAGLTNGKVDADDKPGEIDDGWADYLPSLLDFPYERYGIQIPDAVVDKEPSMVETAKIDEGEVLQAVQTEVTDN

SEQ ID NO: 23379 - protein, 313 aa, Neurospora crassa
MAEQQKVLGMPPFVADFLMGGVSAAVSKTAAAPIERIKLLVQNQDEMIRAGRLDRRYNGIIDCFKRTTADEGVMALWRGNTANVIRYFPTQALNFAFRDKFKKMFGYKKDVDGYWKWMAGNLASGGAAGATSLLFVYSLDYARTRLANDAKSAKKGGERQFNGLVDVYRKTIASDGIAGLYRGFGPSVAGIVVYRGLYFGLYDSIKPVLLVGDLKNNFLASFALGWCVTTAAGIASYPLDTIRRRMMMTSGEAVKYKSSFDAASQIVAKEGVKSLFKGAGANILRGVAGAGVLSIYDQLQVLLFGKAFKGGSG

SEQ ID NO: 23380 - protein, 546 aa, Neurospora crassa
MAQAIRSALPDRLMPSNGDEEFAKRHHGKTRSHMVSTILSLCHHPSNKMTVQEELTHRQAFENTSTSIAAAQMRNALTKLAETVKDPDQKKLFETEMDNFFSLFRRYLNDKAKGNEVNWDKIAPPAPHQIVDYESLANNNSVDFLNKLAVLKLNGGLGTSMGCVGPKSVIEVRDGMSFLDMSVRQVEHLNRTYGSNVPILLMNSFNTDDDTAAIIKKYEGHNVDILTFNQSRYPRIYKDSLLPVPKSFDSPLHDWYPPGHGDVFESLYNSGILDKLIERGIEIIFLSNADNLGAVVDLRILQHMVETDAEYIMELTNKTKADVKGGTIIDYEGSVRLLEIAQVPKEHVNEFKSIKKFKYFNTNNIWMNVQAVKRVVENNELELEIIPNEKTIPGDKKGESDISIVQLETAVGAAIKHFKGAHGVNVPRRRFLPVKTCSDLMLVKSDLYTVKHGQLQMSSARFGDAPLIKLGNDFKKVSDFQKRIPSIPKIIELDHLTITGAVNLGRGVTLKGTVIIVATEGQTIDIPPGSILENVVVQGSLRLLEH

SEQ ID NO: 23381 - protein, 262 aa, Neurospora crassa
MGHEDAVYLAKLAEQAERYEEMVENMKIVASEDRDLTVEERNLLSVAYKNVIGARRASWRIVTSIEQKEESKGNSTQVSLIKEYRQKIESELAKICEDILSVLDQHLIPSATTGESKVFYHKMKGDYHRYLAEFAVGDKRKDSADKSLDAYKNATDVAQTELPPTHPIRLGLALNFSVFYYEILNAPDQACHLAKQAFDDAIAELDTLSEESYKDSTLIMQLLRDNLTLWTSSEAEAPAAQGEAAPEEPKADAPAAEEPKAE

SEQ ID NO: 23382 - protein, 712 aa, Neurospora crassa
MAPRAEGSSTLKRARGSTDDNDSFKKPRRSERLSSQRTGDSPEPKQKTPLKTTKQLPSPVTHDSDEFPQDSKEPTATPPAGRPSQLSQISPRPENQHSQSQASQLNDTQAFSQLPDLDKALSDEVEDEVKEGVWGYLFPLDPRYGGRCVVLRRRAACPLPDTVSQAVGSKRGKRGQKALIKEEHDLDKTKVKGLPSGGYLIGRHPECDIQIEDPIVSNRHCIIFTENKGNDTIAVLEDLSSNGTFVNEAIVGRNRRRELQELDEIAVLGTARFIFRYPKSRHTSAFRQQYTMLQKLGKGHFAEVYLCVEKSTGTQYAVKVFSKTPGVEERSKDEGLQQEIAVLMGVSHPNVLCLKDTFNEPNAVHLVLELAPGGELFNYIVKKTKLSENECRKLFTQLFQGVKYLHDRNIVHRDIKPENILLVDDDLHVKLADFGLAKIIGEESFTTTLCGTPSYVAPEILTDTRHRKYTKAVDVWSLGVVLYICLCGFPPFSDELTSPDFPYSLSDQIRQGKFDYPSPYWDPVDDLALDLIDSMLVVDPEKRFTIDDCLSHPWMTQKTPGVNDSTNGLVNGIAGLDVTRRGVLRERTLLSSINTVEIADKIPLGENKPELKIYKKNPTETVGGPSEHELAGAQAGPSRQKEARPDDNRDPNEFMKMGGKGDEVLFADDPKSNYPTAKKDAKDIVESTTKTNGKGKLASGFGIVIMDARFHG

SEQ ID NO: 23383 - protein, 1298 aa, Neurospora crassa
MTDGPTLAAIAALVKSLAVDPATTQTSGLRPSTHVRLPGPYTREKGDLERELSALVVRIEQLETAAIAASPPAMPDTPNAPTDALFSNGTLSPSSETPDARYPAPLPRNGFIDEALEGLREHVDDQSKLLDSQRQELAGVNAQLIEQKQLQEKALAIIEQERVATLERELWKHQKANEAFQKALREIGEIVTAVARGDLSKKVRMNSVEMDPEITTFKRTINTMMDQLQVFSSEVSRVAREVGTEGILGGQAQIEGVDGTWKELTDNVNVMAQNLTDQVREIASVTTAVAHGDLTKKIERPAKGEILQLQQTINTMVDQLRTFASEVTRVARDVGTEGILGGQADVEGVQGMWNELTVNVNAMANNLTTQVRDIIKVTTAVAKGDLTQKVQAECRGEIFELKKTINSMVDQLQQFAREVTKIAREVGTEGRLGGQATVHDVQGTWRDLTENVNGMAMNLTTQVREIAKVTTAVAKGDLTKKIGVEVQGEILDLKNTINTMVDRLGTFAFEVSKVAREVGTDGTLGGQAQVDNVEGKWKDLTENVNTMASNLTSQVRGISTVTQAIANGDMSRKIEVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKKKINQMVYNLRDSIQRNTQAREAAELANKTKSEFLANMSHEIRTPMNGIIGMTQLTLDTDLTQYQREMLNIVNSLANSLLTIIDDILDLSKIEARRMVIEEIPYTLRGTVFNALKTLAVKANEKFLDLTYRVDHSVPDHVVGDSFRLRQIILNLVGNAIKFTEHGEVSLTIQKASSVQCSTEEYAIEFVVSDTGIGIPADKLDLIFDTFQQADGSMTRKFGGTGLGLSISKRLVNLMGGDVWVKSEYGKGSKFFFTCVVRLANDDISLIAKQLNPYKSHQVLFIDKGRTGHGPEIAKMLHGLGLVPIVVDSERNPALEKARAAGQAPYDVIIVDSIEDARRLRSVDDFKYLPIVLLAPVVHVSLKSCLDLGITSYMTTPCQLIDLGNGMVPALENRATPSLADNTKSFEILLAEDNTVNQRLAVKILEKYHHVVTVVGNGEEAVEAVKRKKFDVILMDVQMPIMGGFEATAKIREYERSLGSQRTPIIALTAHAMMGDREKCIQAQMDEYLSKPLQQNHLIQTILKCATLGGQLLEKNRERELTRAADAVTGGRRDNGMYSASQAAQHAALRPPLATRGLTAADSLVSGLESPSIVTADKEDPLSRARASLSEPNIHKAS

SEQ ID NO: 23384 - protein, 375 aa, Neurospora crassa
MAAPRTTTALVIPELNGQFELQEVRLNDIQPDEVLVEIEAFGICHTDLSFAAGLLPCRPGAVLGHEGAGKVLSVGSSSTSHLSPGDSVLLSFSHCDSCPSCLSGHPAYCHSFNARNFSGCRPLPVHPDGSIDSSSFLKSDPTVDPSYATFLTPDTNKPIFSQFFGQSSFARHTLVHKSCCVKVPPGTNLALYAPMGCGMQTGAGAVLNSLGVKPGSSIAVFGVGSVGMAAVMAAAHIAKAKTIIAIDLQASRLELAQKLGATHTVLGENNNNNKSSSSGEEEMIKKEVRRICPPVGVDYAVDCTGSVAVIKTMIEVLGTRGRAATVGAPGFGKVVGVDVMEHLTYGKEYVGSCEGDSLPKEVSSACCLRGLGWWW

SEQ ID NO: 23385 - protein, 438 aa, Neurospora crassa
MADLLYDLLSPSFSGDPSSRPAPDSSSLEYLTSLSSQPLTALETTEPQALAQTSHGLLLSIQALSKKSHKQVIESATHHSTLRTSLPALAASTADLRHSIPKLDHEAVRFSTNYSKSSESDVLLRRKKALLLSRNVERLVDVLELPNLLSTAISTAPVNYSSALDLNGHIRRLHSLYPDSPLVTSIAAQADEAMRTMAANLIQSLKSPGLKLAASLRTISWLRRVLPDLEAAGTSKGHDSQERVLGALFLVCRLATLVNMLDALEPLRDLADQEKARQKAIGSGNAWSGGQQTERYLKRYIEIFREQSFAIVSMFRSIFPPAAPKGNGNENLDDPLKQQDALEPMPAALATFPLHLVDMLLETLRLYLPTVKDQASRDSLLTQVLYCAGSLGRLGGDFGLFLASLDLGPEAEEEWVEVVKRHRALAGRLESIVGDQKK

SEQ ID NO: 23386 - protein, 328 aa, Neurospora crassa
MENYQKLEKIGEGTYGVVYKARDLANSGRIVALKKIRLEAEDEGVPSTAIREISLLKEMRDPNIVRLLNIVHADGGQGHKLYLVFEFLDLDLKKYMEALPVSDGGRGKALPEGTGAGLHNLGLGEDIIKKFMSQLCEGVRYCHSHRVLHRDLKPQNLLIDRDGNLKLADFGLARAFGVPLRTYTHEVVTLWYRAPEILLGGRQYSTGVDMWSVGCIFAEMCTRKPLFPGDSEIDEIFKIFRLLGTPTEDIWPGVTSYPDFKASFPKWVRDYNVPLCQNLDDVGLELLESMLVYDPAGRISAKAACNHPYFEDYNPKPKSKYRDSSRYA

SEQ ID NO: 23387 - protein, 97 aa, Neurospora crassa
MSAQQYYQQGPPPQGYGPPPHQEGYPQYPQQSYGQPPPQGYYPPQGQMQYQQQPPPQQSGGGDGCFKGCMAALCCCFVGAECCECCADCCECCAECC

SEQ ID NO: 23388 - protein, 688 aa, Neurospora crassa
MSPPTQEGTSPTTLSVLSLDATSASSPSPTGDNTPHALPGTSSAFTSGIGTAGASGHATPTVSARRTGTGSYNLDISGDEDPHVTVDTVSVPVVLSTTPSATSTLKSKQHFDLAICAHDEAVKHTDATPYLNSDSFDIEMAPISGVGGGHRRRRSSLMNPVGASSSSRHRSPRPRSSAGKGIDFDEVKSVGEDTRVQEVAGRYDGPSDDDLSDEDLHIDEEAGLTGADKRRKSRKRSRNTQLDQRIARDRISEAEKLEADRAVLKNAVINVTLILLWYFFSLSISLYNKWMFDPKKLNFRFPLFTTATHMLVQFSLASIVLFFFPSLRPTNGHKSDLGQSRHEPERPVMTKWFYLTRIGPCGLATGLDIGLGNASLQFITLTFYTMCKSSSLAFVLLFAFLFRLESPTWRLVAIIATMTFGVVMMVAGEVEFKLGGFLLVISASFFSGFRWGLTQILLLRNPATSNPFSSIFFLAPVMFLSLISIAIPIEGFSALFAGLKVIAEEHGMLMAPLLIVFPGTIAFLMTASEFALLKRTSVVTLSIAGIFKEAVTISAAAIVFGDTMTVINVMGLLVTLAAIAMYNYLKISKMRQDAQNNVHRAHMVGGDSGSGSSSSASTSRSGSRSGSGGSSSERDGEGEDVEDEGRGFLDGAVAETLFTADGDVIKRSPDLPATRDRGRSADQTHRAD

SEQ ID NO: 23389 - protein, 536 aa, Neurospora crassa
MAVNGNNTFLDHTSAMEVLKEYERRDGLDIRDLMDSKLQGGLTYNDFLLLPGYIGFPASAVTLDSPITKRITLKTPLVSSPMDTVTEHEMAIHMALQGGVGVIHHNCSPDEQADMVRKVKRYENGFILDPVVITRDTTVGEAKALKEKWGFGGFPVTESGNLGSKLVGIVTNRDIQFETDLDKPVSEVMVTDLITATAGVNLLEANKILAESKKGKLPIIDKEGNLVSMISRSDLTKNLHFPLASKTKDSKQLICAAAIGTRPEDKDRLAKLVDAGLDIVILDSSQGNSMYQIEMIKWIKKEFPDLDVIGGNVVTREQAAALIAAGVDGLRIGMGSGSACITQEVMAVGRPQATAVYNVSSFAARFGVPCIADGGIQNVGHIVKGLALGASTVMMGGLLAGTTESPGTSFVSREGKLVKAYRGMGSIDAMQDKKAGGGGKDAQKSNAGTARYFSEGDSILVAQGVSGAVAHRGSINKFVPYLAAGLKHSLQDCGMTSLQELHECVENGTVRFEIRTASAQLEGGVNMESYEKKLYA

SEQ ID NO: 23390 - protein, 291 aa, Neurospora crassa
MARRGKYSEVFEGINVVNYQKCVIKVLKPVKKKKIKREIKILQNLAGGPNIVALLDVVRDSQSKTPSLIFEYVNNTEFRTLYPRFNDFDVRYYIFELLKALDFCHSKGIMHRDVKPHNLRLIDWGLAEFYHPGTEYNVRVASRYFKGPELLVDFQEYDYSLDMWSLGAMFASMIFRKEPFFHGQSNSDQLVKIAKVLGTDELFDYLDKYEIELDAQYDDILGRFQRKPWHSFINAENQRFVSNEAIDFLDKLLRYDHNERLTAKEAMAHPYFAPVRDEATRARYLAGETIN

SEQ ID NO: 23391 - protein, 165 aa, Neurospora crassa
MAPMNNFFRAARPVFRNTFFTSNAARNGGKRFQSTASSEQAQESFFKRMWNSPIGFKTVHFWAPVMKWGLVLAGISDFARPAEKLSLTQNAALTATGLIWTRWCLIIKPKNYLLAAVNFFLGIVGVVQVSRILMWQQSQKNKTLPAAAEEVKENVKEEVKKVVKA

SEQ ID NO: 23392 - protein, 1602 aa, Neurospora crassa
MHPSFLTSGIIDLLEADQRPSFIVALTPHPPTIVYTNPALDADARLPDAITTRKRNNVQLWEWLTDLSDVCPSGTGQAAANFSFMNIYWTRTIVRPDMVVVGANDQPPFSEPPSQSRVDEASPVGSTVPPPVRLIPVKDDAPESIQTSAATTASTTTTAATLAVPSLTSSMSLAPPDYTSLSRTRSGPPTLPLGSAEYPLASPEMIQSLKRSTTDPGWILPDILPEQTFHQILADSRPIAIYWGTNYVTLYNEAFSKLCGSKHPSLLGMTVENAWQEAGEQLKDAMSRIARKEDPTIEDEWRFFIEREPEVEGGPHWLEETYLKWSLVPILEKERCVGFIHPVGDTTSVRLWERRMQMLVELGEDLPAARDVNGYWNKTLQELADVDPCYDIPLAILYSVEAFEEGSAMKIGSDGPTKQCRLAGALGVPEGHPIAQTAINLSTNEHALAPALREAVTAHQPLLLQTKDGTLPQEYLRGLQTRGFKDDPCRAVVIMPIRPTKKEDAMGLLLLGLNPRRPYDNDYRQYILLLSQKLTTSLASVVLLEEEARRGRNAAEQAAYDQAMLKEKLAIQTKEANESIKMFEALVEFVPVGMCFGDPQGNITFANDAWYKMTGFPGKCPIRNSGFLACVKEEDRQNILTAHEKLKTEHYVEYEFRVKPKNLTNVTPSLTRNSPSFEKAGLDLVPIDQSKERHIFATAKAERAPDGSIIRTMTCLTDVTAHKHAAEEAVRRAQQAENLKRMAEFATVGMYDMDLEGRLLGANNVFYEMCGLPKIDPTEVTIRPLETCVLAEDVGLVTKKLKKMVAEDKVQNVEVRLRTTWTADDGAGHKMVMPRWVQATLMPVRSAEGVIQTFTGCLSDVSLQKWQLDREKQRKEEAIESKRQQENFIDMTSHEMRNPLSAIIHCADAITATLSRVQELVGGDHHGSDSDARSYVSEGTADNQPNHELRAEVCELLDNGIDSAETIVGCAQHQKRIVDDILTMSKLDSKLLAITPITVNPVQMVKEALKMFEVEARRVDINLSMVVDQSYYDLGVKYLDFDPSRLKQVLINLLTNALKFTKTGPTRNVTVGLSASLTRPTEATSSVQFIPRSQESHAEDSDTASVHDRGEPMFLLFEVKDTGQGLTEDEKKSLFQRFVQASSRTHIKYGGSGLGLFISRRLTELQNGAIGVASQPGVGSTFAFYIEAHHPSERSLRDAEATAVAAKAVMSADLMTKAPNIRSMRPSNPHRGSTSSPRPSPVPSSPVVELGGLVTPPPQIRGIMVVEDNLINQQITRRGLSSMGFTVDVANHGLECLDKLQRTDRYVSDQGSGTALPMNGSINNKGALPALNGTISPLSPPVSGSFLNQSQAPPATTTIATPATKFPLSVILMDIEMPIQDGLTCTRNIRELERQGKITGGRLPIIAVSANARIEQILEAKEAGCDDVLIKPYRMPELLEKMRIVMGTVANANAAAAAAAAAAAASAGPGAGQTGSASSSAASGSGSPGGFGGLGEPVVQRQIQTGEKEHKQDITTQAQTGSQSQSQRQQGSEEHNKQAAGQSQAQAQAQAQTQAHTQTQTPNQGLSPDGKPIETPWTSPSPSPKQTTQTKVELVSMQQLSP

SEQ ID NO: 23393 - protein, 270 aa, Neurospora crassa
MANERERCVKTFLARLCEQAERYDEMVTFMKEVAKLGGELTVDERNLLSVAYKNVVGTRRASWRIISSIEQKEESKGSDKHVAIIKEYRQKIETELETVCKDVLEVLDEALIPHAATGESKVFYHKMKGDYHRYLAEFASGEKRKNAATAAHEAYKNATDVAQTELTPTHPIRLGLALNFSVFYYEILNSPDRACHLAKQAFDDAIAELDSLSEESYRDSTLIMQLLRDNLTLWTSSDNGEPEAAAEAPKAEEKAEEKAEAAEEKAPEEQ

SEQ ID NO: 23394 - protein, 454 aa, Neurospora crassa
MADLVGRKIFKVFNQDFIVDERYTVTKELGQGAYGIVWYVHLLLLPFLLSRLCFWAAAHLHVSCHILMIQADLPFLLNSAAVNTQTNEGVAIKKVTNVFSKKILAKRALREIKLLQHFRGHRNITCLYDMDIPRPEMFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKAIDVWSVGCILAELLGGRPFFKGRDYVDQLNQILHILGTPNEETLSRIGSPRAQEYVRNLPPMPKKSFQQLFPQANPDALDLLDRMLAFDPTSRISVEDALKHPYLAIWHDASDEPDCPTPFNFDFEVVDDVGEMRKMILDEVFRFRQLVRTVPGGQGQGGAQPQAPAQVPMPTDVHSQQWTAEDPRPHEYGAYNGGLEAELGGM

SEQ ID NO: 23395 - protein, 339 aa, Neurospora crassa
MPALLSVLGLGSPRKHQSAHYLDNNTNPDILAEKLDNMGSCANITKAQMIALSILDTHKQLKKLPAYQPGEEINRLLGNLVHTCVQIHPPSVIQQILNFPGLQQILPSLRTICSEAESCLETHWAEHTLALAAHQGHETVLKAVQTDFPYFQNYIDLARLELSAIRAALPPNNTAPLKKITFIGSGPLPLTSWCLLDEIRKTAGQNDMIPTICNIDMSPTAIDVSSQLNGALGPWGEGMEFLCGEAGSPSISLEDSDVVYVAALVGMSQKDKEEIFLKVVRTMRPGALLVVRSAWGLRTCLYPEVNVTTERLLGVLECCAVVHPFTDVVNSVVVARVRG

SEQ ID NO: 23396 - protein, 137 aa, Botryotinia fuckeliana
MTGGKSAGGKAGTTKNAQSRFHPKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQSLLPKKTAKTAGGKPASQEL

SEQ ID NO: 23397 - protein, 713 aa, Neurospora crassa
MAILEEKKSFDASAANVRPFSESTPAYENASDVKEKVSVEVESTGEIEEEDLFAPLKMDASVVHEENPLTIRAVVTGIVLGCLVSASNLYLGLKTGFTFSANMFGAIFGYGIIKMMSKSGQVPIIGGAFGPQENSIIQAAATGAGGISGIFVAGIPAMYQLRAMGENATPQKDIGAIFTITLVCSFLGLFYVTPLRKFFVVQVARELKLIFPTPTAVALTIRSMHAGAAGSIEAMKKLKCLGLAFGAALAHRIGSYYAIGILYDWHVFTWIHIWSGYKSWALNIESWGWYFEWTPAFIGSGILIGLNPAISMFAGSFMAWGIIGPVLVHYGECIGTQSYPDDPHWDSLYNFFSLQNLGKVTPSPRYWLLWPGVMVMVCSSMAELLVQYKVIWFGLKSSWQQTCVSINDTLVARGKTNSFFSKQAAKVVRTGEEVEDPAKANEQVKHWHWIVGLIVSMVIAMIIFHFQWDMHPGLTILAAILAFLFSFLAIQIGAVTDSAPLTAASKASQLIFGGATRNSGFSIQHAQKINLAAGGLASGGADVANALVSDFRTGFLLGTPPLKQWIAQAIGTFVAVWLAPGLFVLFTKAYPCIYDPNFADTNCAFQIPSVSAWAAVARAVTDPTVKIPLSSGIFAIVMGVVSIIQVIVRHYYLVGERESWREWLPNWGAIALSWVIPAPVFANAALLGAIIAALWRKYSMRTWDLYGYALAAG

SEQ ID NO: 23398 - protein, 460 aa, Neurospora crassa
MSYGYPGQGYGPGGGHHQPPPPQWDGQQQHHHQGGYGYSNPGQGQYNPQPPQDQGYGGYHQQPPQQYQQGSYNQGQYPPQGGYGGPYGQQQQHHQQGHSQRPPGPPPDGYDIYGYPIGSGHQTRNQGSHEIHEIPSGTQQFGHGAPEGYGFQYSNCSGRRKALLIGINYLGQDAELHGCINDTKNVSAFLVENYGYKREDMVILTDDATNPLLQPTKENILRAMQWLVAGAQPNDALFLHYSGSQPPTGHGGQTKDTDGDEDDGYDEVIYPVDFKTAGHIVDDQIHDTVVKPLQPGVRLTAIFDSCHSGSVLDLPYIYSTKGVIKEPNLAKEAGQGLLAAVGSYARGDIGGMASSLFSVAKTAFGGGNEAYERTKRTKTSPADVIMWSGSKDDQTSADATIASQATGAMSWAFITAIKANPKQSYVQLLNSIRDVLETKYTQKPQLSSSHPIDVDMLFVM

SEQ ID NO: 23399 - protein, 338 aa, Neurospora crassa
MSSSPTFKDKDEDLEAQVPLNPQPSNPTVRTEQEVSGTTKLLYLAVYFLCNISLTIYNKLILGKFSYPWLLTALHAGSASIGCYILLLQGRFTLTKLSLQQNIVLFLFSILFTVNIATSNVSLAMVSIPFHQIMRSTCPFFAVLIYRFRYGRSYPRDTYLSLIPLILGVGLATYGDYYFTAAGFLLTFLGVILAVVKTVATNRIMTGALALSPLETLLRMSPLACAQALVCAIASGELAGFKEQNPEGPSGALILTLAGNGLLAFCLNYSSFSTNKVAGAVTMTVCGNIKQCLTILLGIVLFGVKVGFLNGLGMVIALAGAAWYSVVELRSKTQKGGR

SEQ ID NO: 23400 - protein, 467 aa, Arabidopsis thaliana
MSQADFGRLELELAEVEMPGLMACRTEFGPSQPFKGARITGSLHMTIQTAVLIETLTALGAQVRWCSCNIFSTQDHARAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQQNGTLLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKAGIIVLAQGRLMNLGCATGHPSFVMSCSFTNQVIAQLELWNEKASGKYEKKVYVLPKHLDEKVALLHLGKLGARLRKLSKDQSDYVSIPIEGPYKPPHYRY

SEQ ID NO: 23401 - protein, 601 aa, Neurospora crassa
MATAEIVAADASSNYDLEKHNTASTTQKHIPIEDDYEGKPTQEELDTLRRVPGSLPIIAYMICIIEFCERASYYGVQPLISNYVNRPLPQGGNGWGAPARGTQQTAGALGMGQSTSNAVTQSFSMLAYALPLVFGWLADAKTGRFKLICWGVIVFGIAHVLLIVAGAKNLLADGTSKAPFFIAVYILAFGAGMFKPNVSPLLLDQVTNTKPMIKVLKTGERVIEDPEATTERVMLWFYLMINIGGFMGVATAYSEKYIGWWLAFLIPLILYLPLPLLLWFLRKRLILHPPGGSDLPNVFRVLGVCLRRGGIKKIGRHGFWELAKPSNIAAAGLEGTYKTQWSDQFVEDVRRTFQGTGIFCFFPIQYLNDNGLGSAANFLSTMLRTDGVPNDVISNFNSLSIIATAPVLNYGLYPALRRLGIHYGPIARITTGLALSTLGGVGYTLLNYYAYKLSPCGEYGSSDCTIGTGVANISIWYLAIPFAIGGISELFVNVPAYGIAYSRAPVNMRGLVSAINLFSTAVAYIIGLACSSVVTDPYLTWDFGGPAIAGGVLTIIFYITFRHIDKEETVFSQRETIEATPVEDSSSQVGEKPSPVYSEKK

SEQ ID NO: 23402 - protein, 1188 aa, Neurospora crassa
MEWLSEFHTHLWKRAAEELNKNIKLINESDDPRIGSGRDGASGGTLSHSSGDNKDPASLSALGSTFVPVLVYAAICLLIFFTFRRISTRTYAPRTIAQLREPEHPAQTLPNGWIDWVKPFWKIDDDYILNNCSLDGYLFLRFLKILSVICFAGLAISWPILLPINATGGNLQRQLDKLTMGNIKLPSKYYAHVVVAWLFFGFVLFMVCRECIYYINLRQAYLLSPNMSNRLSARTVLFTCIPKPYLDEAKLRKLFGDSVKNIWIPKNTNYLRGLVEDRDDVAERLEKAEIELIKKANTVRMKNIREGKGAPPFAGEPAIDDLQSSKTSSSSLHESNESTQDGDLEKGTEPNPVRIRERRTEAPPIPVDEIETPALPGDDPGAPKKSKDDDLGPEYQHPYGYPASLPDVRGSVAALFVRANDRPHHRPLHNFGRRVDTIRWTRARLKVLNRDIWKLRRKFRAGDGQPLSSAFVEFDSQASAEAAYQILSHHQPMHMSPRYIGVRPEQVIWSSLRIRWWEQIMRQFLMLALVVVAIIFWSIPSAAVGIISNIDFLSEKVPFLFWIPLLPKVILGVIKGLLPAVALSMLMAIVPAGLRVCARVAGCPSHALVELYCQSAYFAFQVIQVFLVTTITSAASAAIIDVIKQPMSAPNLLAQNLPKASNFYLSYILVQCLGAGAGKLANVSDLLRHYVATSFMVDPRKAYHRWRKLTPIHWGAVYPRFTNMGVIALAYSCISPLILVFAGFGMLFVGLVYRYNLIYIHDDSELDTKGLLYPRALLHLMVGLYIAEICLIGLFALKKAFGPMLLMILFFGFCAITHYSLSSALSPLLASLPQTLALEKQHGQIAEDGDGDDHDINPVSRPTPSDPTSAQGGGGLAADYYNDTSISTPGADIPAEVIGGSAADYYASISFDYSDPSTDDPEPPGLYDDDFDSDGPQSQRMRGLEGSSSIRHSITEFAKTTLKSQLSNLKASANGTGPPGRLSPFTRFLYRIHRFLTPDPSIQNPNLIQRWLHPSVYADFRTLAKKVGNGPGPDGWELPKGYENKRGYYPPEMWKPAPRLWIPRDTGRVSRQEVRHNRDAGVWCTDVGCWLDDGVGEAPWDDGKDKRGSSEDSEKGVEGENMRGTEAEPESKEGKAMDLEDGKKVNRKGIWKGVGKEAKKATGRVKPGRVRVRFNVEEGPMGEERWLF

SEQ ID NO: 23403 - protein, 344 aa, Neurospora crassa
MAPSLEAEPESVASVLANPQKPQLVAPEPEHCPGPESQQAGTADSCAGCPNQAICATAPKGPDPDIPLITARLSGVKHKILILSGKGGVGKSTFTSLLAHAFATNAEQTVGVMDTDICGPSIPKMLGVEGETIHVSSTGWSPAWAMDNLAVMSIQFMLPNRDDAIIWRGPKKNGLIKQFLKDVEWGDLDFLLVDTPPGTSDEHLSVNTYLKKSGIDGAVMVTTPQEVSLLDVRKEIDFCRKAGIKVLGLVENMSGFVCPKCTHESEIFKATTGGGRKLAEEMGIAFLGSVPLDPRIGMACDYGESFFDSFPDSPACRALKGVVKGLATEMGLDPEVVMPEEDDA

SEQ ID NO: 23404 - protein, 588 aa, Neurospora crassa
MKSALGCVFSALAASVSSSSLHALRQTPPQLDYNLLPRAACDNTNKSRSCWGNYSIDTNYYDETPDTGVTREYWLSVEEGDCAPDGYARQCQTINGTVPGPTIFADWGDSLIIHVTNNLKSNGTGIHWHGLRQSGSNIYDGVPGITQCAIAIGQSMTYRFKVSQYGSTWYHSHFSLQYANGVFGGMIFNGPATANYDEDLGHLFLSDWSHVDVFTRWFAARNGQPPALESGLINGTNKFDCSTSSTDPNCTGRGVKLTTVVEKGKKYRLRLVNAAVDGVFQFSIDKHKLKVIAADLVPIKPYSTSSLKLTEGQRYDIIFHANQAVDNYWVRAGWLNACQPNVNPDSITSVLRYNASSTLDPTSTSDVTVSSDCLDEPLASLVPHLKMDVTNIQKSFDTYLNISTTNYVHWTINTSSLLIDWNNPTLKQVFNGESLFPTDYNVLAINKTTTDDEWIVLVIQDQSNLGLEHPIHLHGHDFWILDQSTGTFDAATSPQSFKTKNPPRRDVAALPGNGYLAIAFMPDNPGAWLCHCHIAWHASEGLSLEFLEREADIQADVSDSDRTQFNDICQTWSDNVGTQAFPQEDSGI

SEQ ID NO: 23405 - protein, 1208 aa, Neurospora crassa
MLRRPSGHVACRPEVLLAFAFLLVNLQWLQLVDAQPHHHARSPREDDDHAVPNIATLSTLTGGRPQPVIETPRTHGRGKRTVVEIADGPKTESIRLSYHAQSDNTNNNNHADLISNNVRANALAPDSSVRAPLTQSNKVGSLGAELSQHQIARSLEDWEVEDFVLLATVDGDLYATDRVRGEVRWHFKADHPMVETRHFRTSRSPVDEDFHEMDHWIWIVEPTRDGEIYIWRPSDSGPQLTKMTMTMKQLVETYSGLHMNGIVYTGEKRTNMVTLNAATGAMIKNLGPRGVNINKVESERCLREYALGNSITSECSNRETITLGRTEYIVGVYRTDGSPIASLKYSEWAPNVLDGDLGQQHSATPDKRYITGKPDGTFFGFGLDRENGDRPLFSHQLTSPVARVFDVLRRQWNPTGSSDTDLIILPQPLFPVNPAISRLRSAKVFVNHTEEGSWYALSGTQYPLILHAPPAPIHKFWPLESLNEDKLSEALVGTHDLPDWRIPKEINRLVPLLDAPPPPAGDAVITGNPTVPSSAGALPGLPAPDTATALPVQASDFFLNPFTLLVGIVIVIAVWTRAWIPQSSKKGYSLEGFLDFMRTLGRKVVDLTRFRIHVVRTEPTPTVTDITPRLEAAKEESSKPDASLADSSAGDSGSDEGLAKKEVTFADLPKSSETPPPVDTTDAPAEVVKPKRKAHRGRRGGIKHRKGPRNENTQSRDDEPPEPTVDEVVKKAQEIGQQPKLEPDVITIPNGVDNVSGPILKMGSLEVNQEQQLGIGSNGTIVFAGKWDGRDVAVKRMLVQFNEIASQETKLLRESDDHPNVIRYFAQQQSAGFLYIALELCQASLADVIQRPSMFRELAQAGERDMPGVLYQVAKGLSHLHSLRIVHRDLKPQNILVNMGKDGRPRILVSDFGLCKKLEGGQSSFGATTAHAAGTTGWRAPELLLDDDGGPGPGATMTFTDPGSSMHSASGTGSGVVGAGVNVRRVTRAIDIFSLGLVFFYVLTKGHHPFDLGDRYMRESNIRKGKYDLQLLEVLGDYAHDAKDLIESMLNSNPKKRPTAIGVMAHPFFWSPRKRLNFLCDVSDHFEKEPRDPPSPALALLEDQSSCVITNGDFLKTLPREFVESLGKQRKYTGNRMLDLLRALRNKKNHYEDLTPQLRKMVGPLPEGYLGFFTTRFPNLLIKCWEVIADLELEESDRFKEYYEPAGL

SEQ ID NO: 23406 - protein, 452 aa, Neurospora crassa
MSAANGRQPEVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKTGHGKPVDIWALGVITYFLLCGYTPFDRDSDFEEMQAILNADYSFTPLEYWRGVSDNAKDFIRRCLTIDPAKRMTAHEALQHPFVAGWARGTDGAEADKGANLLPTVKKNFNARRTLHAAIDTVRAINKLREGQFMNGGRSREPAKKAAAALGPTLGKEASMVSTASSNVTKDSGYATQPEGEGGSRDGDDVLMKDASVPAPTSSSPAPCRVSYGRAVSRIRLSRLVKACGMGLVLSDDQFLGLSSLTNGGWFCSIVIIF

SEQ ID NO: 23407 - protein, 1262 aa, Neurospora crassa
MNNNYYGSPLSPEELQHQMHQHQQQQQQQQQQQQQQQQQQQQQQQQQQQQHQHQQQQKTNQHRNAGMMNTPPTTNQGNSTIHASDVTMSGGSDSLDEIIQQNLDEMHRRRSVPQPYGGQTRRLSMFDYANPNDGFSDYQLDNMSGNYGDMTGGMGMSGHSSPYAGQNIMAMSDHSGGYSHMSPNVMGNMMTYPNLNMYHSPPIENPYSSAGLDTIRTDFSMDMNMDSGSVSAASVHPTPGLNKQDDEMMTMEQGFGGGDDANASHQAQQNMGGLTPAMTPAMTPAMTPGVSNFAQGMATPVSQDAASTPATTFQSPSLSATTQTIRIGPPPPPSVTNAPTPAPFTSTPSGGGASQTKSIYSKSGFDMLRALWYVASRKDPKLKLGAVDMSCAFVVCDVTLNDCPIIYVSDNFQNLTGYSRHEIVGRNCRFLQAPDGNVEAGTKREFVENNAVYTLKKTIAEGQEIQQSLINYRKGGKPFLNLLTMIPIPWDTEEIRYFIGFQIDLVECPDAIIGQEGNGPMQVNYTHSDIGQYIWTPPTQKQLEPADGQTLGVDDVSTLLQQCNSKGVASDWHKQSWDKMLLENADDVVHVLSLKGLFLYLSPACKKVLEYDASDLVGTSLSSICHPSDIVPVTRELKEAQQHTPVNIVFRIRRKNSGYTWFESHGTLFNEQGKGRKCIILVGRKRPVFALHRKDLELNGGIGDSEIWTKVSTSGMFLFVSSNVRSLLDLLPENLQGTSMQDLMRKESRAEFGRTIEKARKGKIASCKHEVQNKRGQVLQAYTTFYPGDGGEGQRPTFLLAQTKLLKASSRTLAPATVTVKNMSPGGVPLSPMKGIQTDSDSNTLMGGMSKSGSSDSTGAMVSARSSAGPGQDAALDADNIFDELKTTRCTSWQYELRQMEKVNRMLAEELAQLLSNKKKRKRRKGGGNMVRDCANCHTRNTPEWRRGPSGNRDLCNSCGLRWAKQTGRVSPRTSSRGGNGDSMSKKSNSPSHSSPLHREVGNDSPSTTTATKNSPSLRGSSTTAPGTITTDSGPAVASSASGTGSTTIATSANSAASTVNALGPPATGPSGGSPAQHLPPHLQGTHLNAQAMQRVHQHKQHQQHQQQHQQQHQQQHQQQHQQLQQHQFNPPQSQPLLEGGSGFRGSGMEMTSIREEMGEHQQGLSQQLQDQGRCQTHRLGQQQQKQQQQQEGEQQQHKEHSSTSLPSQRQRLHKELSTTTSCRTAKEVATAAANANTAAAAGAAVRVTTPIITDRRTERRY

SEQ ID NO: 23408 - protein, 352 aa, Neurospora crassa
MSSAQRGGARKISFNVSEQYDIQDVVGEGAYGVVCSAVHKPSGQKVAIKKITPFDHSMFCLRTLREMKLLRYFNHENIISILDIQKPRSYETFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSELALDLLEKLLAFNPVKRITVEEALKHPYLEPYHDPDDEPTAPPIPEEFFDFDKHKDNLSKEQLKQLIYQEIMR

SEQ ID NO: 23409 - protein, 441 aa, Neurospora crassa
MSGYPGAGYNGGGYVPPPQPQYGGYYPPQPAYNAYQQPPPQQQQYMVYHQPSPGPQQHQHWNPQQQGYGNPPNSHYGRPEANMPTVNSNSYAHGNHQAPPPPPQAPQQFGYGAPADYAFRYSQCNGRHKALLIGINYFGQRGQLRGCINDVRNMSSYLVEHFRYKREDMVILTDDQQNPMSQPTKQNILRAMHWLVKDARPNDSLFFHYSGHGGQTKDLDGDEEDGYDEVIYPVDFRQVGHITDDEMHRIMVRPLQAGVRLTAIFDSCHSGTALDLPYIYSTQGILKEPNLAKEAGQGLLGAISSYSQGDLYGVANNIMGIFKKATGGNDAHARTLATKTSPADVVMFSGSKDDQTSADATIASQATGAMSWAFINALKKNPQQSYVQLLNSIRDELQMRYTQKPQLSCSHPLGEASSSSHSSSSFYNPSSSRYLVTTFKI

SEQ ID NO: 23410 - protein, 134 aa, Neurospora crassa
MTGGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTGKTGKNASQEL

SEQ ID NO: 23411 - protein, 310 aa, Neurospora crassa
MSTIMASSPTHTPPPSTVPRPKGILKNSYRNSPPAGPTSPLDTHHHDAAHPPPLIHMPSSAKEAKEITIMNTQINAGPRRSSSVAGSRPGLSGSRRSTTPSHHGDEDSTEQGQRLKWDEANLYLTEQERSSTMKIDEPKTPYAKHYDPAEDPSDDDEEVPEAIDPNKIDMDRVDGLSPLPRQNKRRHGNIDDEIPGLSLGEPEEAVPEGGFPFGKGATAHSEDGGSPKRPRAVHVDSNGSGHDPDDELVGLSAEEREKHRKFEEMRKKHYEMKSVASLLGHPENLEDEDEDEDEEIPEVPALPTRSNGSS

SEQ ID NO: 23412 - protein, 554 aa, Neurospora crassa
MSGPQYGAQPGGYYNNNNNYPPPPPNSYQMNPMPTDGNYGQQPQYGYGGGPPPQQYGNGYGDGGYAPPQGPPPNGSKPPPTDGYGGPPPSYDEVFKVQKPKYNDWWAGLLFLATVAGFVAVSAISIHGYADNRSQNNGSLNGQRNTFGLTTHTIYLFVWVLICAIVLSYAYMWMARKFTKQFIYATGILNIVMGLVTALYMLSRKYWSGGIVFLIFVVLQALFFWSCRSRIPFSTLMLQTAIDVSKVHGHVYLVSAVGGVIGTLFAAYWAITLVAVYVKFEPDPNNAACRNAGGCSSGKVIGLIVFITFAGYWISEWLKNTIHTTVAGIYGSWYFNSRNYPTKVTRGALKRSLTYSFGSISLGSLFIAIINLIRQLAQAAQQNAAQEGDILGTILWCIFGCLIGILDWLVEFINRYAFCHIALYGKAYFAAAKDTWKMVKDRGIDALINECLIGPVLTFGATFVAYACGLIAYLYMVYTKPAYNDGGGFTPVVVAFAFLIGLQVCNVFTTPLTSGIDTIFVAMAWDPEVLMRDHPDLYHRMVQVYPHVQEAIHA

SEQ ID NO: 23413 - protein, 171 aa, Neurospora crassa
MAENDERALQKVSLQSNDGQIITVDRVVAERSLLIKNLIEDLGDEAVMNEAIPLPNVNEPVLRKVVEWCEHHRKDPPQTTEDENDSRKKSTEIDEWDQKFMQVDQEMLFEIILAANYMDIKPLLDVGCKTVANMIKGKSPEEIRKTFNITNDFTPEEEEQIRRENEWAEDR

SEQ ID NO: 23414 - protein, 700 aa, Neurospora crassa
MAYRLSLLQYLVSVLVLCKHVLTLDFGQSYSAGNSDLLAPRRYTEHDLKRKGLSDHVSFHPEGASEGFYCHYPDLKSKEWEACNDGADSRWCWLRQLQAQEGESRPKGYTVTTNYDNFTPIGIQRHYHMDISKQTIAPDGTPREARLMNGTYPGPTIEACWGDTVIVHVTNNLDDEGSVIHWHGLRQFYNNDQDGVALTQCPIARGSTWTYNFTMLQYGTTWYHSHYILQYADGVLGPVVVHGPASAPYDVSLPSPHFMSDWVYRKAEEEFENEKDPVVRGSKADNILVNGIGRSKEAVAAYNGEDIQSLYPITEILPGQRVRLRLINGAAGTSFIFSIDGHALEIIANDLVPVEPQIVDSLLVAVGQRYDIIIHGLDNPSPSGNYWIRTHPADGCNTFRNGLFNSTDSTNEDPLDPRTGILHYGHSSATYLSLPDTTANTISDFSCARVSEQSSLRPVVPWSISTTPLNNLTLSTFYPSHQTEDDVPYGNYTHWLLRLDPLVEKQGGVSFHNPLFANFSTPSLLDFTNIGQGENDNVIRLPYSSHPTDFIHMVIDGSLLPSTNQTDLDPDVIPLLAHPMHWHGSDVVLLAQSEQPFDPATSMDTWNYENPPRRDTIMAPAGGYVAVAFKPDNPGVWLVHCHIAWHASAGLALQMVIDDGQGMVEKMLAGERMKRLEGGCEEWKADLGKVVDYKKEESGV

SEQ ID NO: 23415 - protein, 273 aa, Neurospora crassa
MSAFTIATRRVATQIPRAAAVSTPRAAFSSSVTLQKSISETVKDTLNTVNRAVSDKALDGMDIGSNVASKLKETADTLTNASSPSDLASRVKDAASNAASDAADAIPKDVKGKASELAGEAKGKASELSGKAKGAANEATSGNVSELAGEAKGKASELAGEAKGKASELAGKAKGAANEATSGNLSGAASELTGEAKGKASELAGKAKGAANEAAGGDVQGKAQELKHEASGKASELAGKAKGAVSEGQGKAKGMAQETEKMAKEAGKQSEFS

SEQ ID NO: 23416 - protein, 1233 aa, Neurospora crassa
MDNRTGSRVSVRQPLGDATNRANIAAMQTSSRPKLEANAKSWKNTNRSKSNPPIITDIPLVQHHIVTIPSPVAVPDVPSMSRLRHPSSLQQMNTQASDARRVSQFSNVSSNASITRLQKTHIGPWQLGKTLGKGASARVRLARHRTTHQLVAIKIVAKSTAHVTQATSMANLDRVDYRKPSISTDGVRRMPLAIEREVAILKLIQHPNIIKLHDIWENRQDIYLVTEYVEKGDLFDFINWNGSLNEEEAIFYYRQIMSALEYCHSFNICHRDLKPENILLKADGQIKIADFGMAALHQEPTHHLKTACGSPHYAAPELLKHQPYKGSAVDIWAMGVILFAMLAGRLPFDDSDMDAMLQRARKGYYKMPSELSREAKDLIRKILVVNPLQRITMKQMWKHPLIKKYDYVDDYQQSDGQPQDVLRNADIGPIPEKEVDPQILRQLKAMWHAYSEAQIKEKLGQTKPNDQKVFYWLLYRHRHAQLENYNNDIPISKSDFHHLKPPNWGKRISTCEFTQSSRNGHGRSISKFTVISNVAEVNDSGTVRSYDPYRASQVLRNCASEASHARIIVHRNPSEPGTRSNTSNIAHSYNSYTSFGGSFRRRPRMSSQRTNTTGRLRSSMGSMGSLRSLNGTPRVRANNRSRRGVDFSSIRARDRLQARVRENVRAAPSSAAGSSVVDRRNSCRQQQRQKAAIIHSADNTLKSRDETLIWDEELQQLGYRIAMDCDEAFRSSLVGSETSVAVSGSRENSPFSLSLGASSPSPQPESPTALPLQQQAVNHSWVNRPLPPIPSIEISPVVNQTYGVNVVRPAPLRIERLSLGNCASASQTLVPDRRIVSEPVYTTPANRDPRQLPSINETASEDWTRNASTRWASPDTPSPAENNKALNYLARAENTIRVVNSPTAGPVPMPEPLNVRKVSKATPAASGESNYRKTALSNIPPDFKENCPPGTQQEEQGVGDNTVNAGAPAKKRVPSWFRRSSKDNTSFATTANTAAIHNDSTIISDIHQQLDGLESQSSARPDPYPNKKKAFSLAFWKGSKSENSSPTASTFDISTSKEGGGKKHKSSKSESRVVSGATSQSWGEGEGVGRQIEVQQNWLARLFRVKPATRHLCFSMPRRRARQEVAILLREWRQFGIKDVEVDKERNIIFARVGAQNVHNVKEVSFAIEIMMVIEHGKRNQRTQLSIARFTQEKGAASSFHKVVDAINVEFRNRGLLVTDKRKTQMMIKTLNS

SEQ ID NO: 23417 - protein, 701 aa, Neurospora crassa
MSSYLTNFFPSGGKQDGTRPQTPMRPGTSSFVNPVSTPQGSPSKRTLPPGANELPAAFESMKLSTPTKLATSSRPGTSSKLGTPSALDSPIKLGRPQSVVTPLSPGKSNLKDVGDDTFEDLTGNGSAVSVVHKQVDKNLPKPYPVPTSRRKERDQNQENTPPVVTRDPRDPRDPATEPTYQRSHAALSRQELYQARERASPTVKRFNTSRGLTPEERELLNKPNVKRLVNVTQLYFLDYYFDLLTYVGQRQNRLNAFKAEFPPPPETDEETYKQMWHKYAGRERANLRKRRVRLRQGDFQILTQVGQGGYGQVFLAQKKDTKEVCALKVMSKKLLFKLDEVRHVLTERDILTTAKSDWLVRLLYSFQDDKNIYLAMEYVPGGDFRTLLNNTGVLSNRHARFYIAEMFCAVDALHQLGYIHRDLKPENFLVDSTGHVKLTDFGLAAGFLAPAKIESMRIRLEKASETSVPFGKPMDQRTVAERREGYRTMRDRDTNYAKSIVGSPDYMAPEVLRGEEYDYTVDYWSLGCMLFEALTGFPPFAGSTADETWRNLKHWKEVLKRPVWEDPNYFLSNRTWSFITTCINSRSRRFNNIKDIYAHHYFAEVDWAILRETKAPFVPELDSETDAGYFDDFSNEADMAKYKEVHEKQQALEGLAERGEEMNKSLFVGFTFRHRKPATDDGASPRKPIPFEESNNFGTML

SEQ ID NO: 23418 - protein, 225 aa, Neurospora crassa
MGGKRKNAAAARGVSPTPSATSTTPSATVTTKVQPKDSAPPIATTTNAFATSTQIEPTTTTTTTSTTKASGTTSKSSSSSNIDKTAAAAAAGGQQAWNKVFSNLLRHYQDTTPQRTKLLDAFMAFLVVVGGLQFLYCVLAGNYPFNAFLSGFSATVGQFVLTASLRIQTTEANKSDFPSVSPERAFADYLKSIEDERANERGGQKCTSGDVEDCPAIQGLINRSR

SEQ ID NO: 23419 - protein, 255 aa, Neurospora crassa
MSDSPQSNSKDVEQGAPSPGEEPQMNDPQDPHSSGLNQYEFEVKEQDRWLPIANEHFQNKRCAYSLYTSMSHHSSSKSPEAPRASSSSSKADRCDAYDANIRNFAPVARIMKNALPENAKIAKEAKECMQECVSEFISFITSEASEKCQQEKRKTVNGEDILFAMTSLGFENYAEALKIYLSKYREQQQNQTNRSENQQNRPSSQGYGAPQGQNQPGQGGFSSNDLGGQQESGDASGYNLYGAQTGHNGGGAEGY

SEQ ID NO: 23420 - protein, 287 aa, Neurospora crassa
MSGPKYTPAPQEDPDAHLYYPQPPPSYQATAESSAANAVLGDQARLFSGAPRSSQDDDHDIPDDFKFGGSVAEATVEIRHQFIRKVYTILTVQLIATGAVSALSFLSDGYRNWIQSHPAMIWVSFAGALVFMLLTFWKRQSYPTNLLFLSGFTLLEAYTISVCVSFFDSTTVLLAVVITAGIFVFLTAFACQTKYDFTSWMPYLGGALWGLIITGFIYAFLPHTSTSELVYGGVAALVFSGYILVDTQLVMRKYHVEEEIAAAISLYLDILNLFLAILRILNSQSDN

SEQ ID NO: 23421 - protein, 388 aa, Neurospora crassa
MSVPLQNRVSDSSDGIDRIAEEKQKLSVNAPPSTRKQDALGLDDADRQSTTNRFKTFRSAFKYIHHLTPKQVDDYMHSYVIYNLDWADEDAMVKELGPDYQAKVGECLKAYYGIINHLCAMGDVEKMYIPPHMDKRASVIENQLLYEKAVAHAIGMKAGDKVLDLGCGRGRVAAHMASMTGATVTGLNIDPNQVAQAQEFNNLKGFKNTFVQQDMNTLPLPFADNSFDCFYQIQALSLCKDLPTLFREVYRVLKPGAKVSLLDWVSLPGYDPSNPEHLALMRRVKPLIGAVGTPTPKSFEKALEDAGFVVTKSENASIDGLQAPLIDRVDIYFRTMRQIILGLVKIKVLPQHFKTLINRLCLDGQAFVKMDRMRLISTSYWIVAEKPL

SEQ ID NO: 23422 - protein, 193 aa, Neurospora crassa
MAKLFVGGLSWNTDDNMLRAKFEEFGAVEEAVVVKDRDTGRSRGFGFVRYGNDADAENAIANMDGQEVRVDKASDRAAGGGGGGFRQGGGGGGYGGRGGYQGGGGYQGGGGYQGGGGYQGGGYQGGGGGYGGQQYGGQGGYQQSSYGQRSYGQNPQQGYNGGQQQGKGYAAPYGGYPADPSQQGQQYPPQGQY

SEQ ID NO: 23423 - protein, 1448 aa, Neurospora crassa
MYWPIGTPRIYATSASCPPSYPHLYSHDGLPAPDQRPTRASLLSPGPTADGHDASSVPPTPITPVAPFTPAIKSVEHDYYDDGQSEPPSPPPPEPSRSNAPPREPILALRVARAGHLFAVITSTSMTIWQTKPTVVLAVVVRSEASLKSYGTNTSLMLRPDAAIFVVRTSLGYLITYSLATDADSRVYKPHFSSHTNVQKRRQTHAGGPGAIAPDQILWGPGEGSGVRDVSVRFRMVIKVDAGIESALALDDELVVATRKPAAVQCIRWTPDSSGSQTSTELLSRMGWVDKKVMVREMTHDRRMNLSTWVTSDGKAYAVQRISGSQLEPDTNQPPDPKKLFKGYCFYTPQTPGEQAIRCIVNAVFSLIAVGCADGNIRVFSAKDYSGNIPASHVHNLPASNNTCGRLTTLSYSPDGYCLFAGYEKGWATWSVYGKPLSNSFGADQTIASTTGEEWISGVLDAAWIGGGCELLLVGRAHESIWLLEMARSAVTGCYNSANLFRTVLQSTSSVMVYRGYDLPDLTSISAEPGLWHTARIPASYLMNHWPIRCTAISSDGRYVAVAGRRGLAHYSVNSSRWKTFADGDAENQFMVKGGMCWYQNILVAAVEANRSFELRLYSREASLDSSNVLHTQEMSAPVVLVTPSGEDSLLVYTYDNLLYHFIFAPFGGTVRLVEVGHIAFHGIIRSPARVRGLSWILPESQLLDGDPSQDVAHASVLFLVDGKLVLLRPSYNEGGLKYDMRVIANNLEFYVSMRDQPFVGGVLTPSEKQVFTAAADDSLRNSLWIFDGSEIKTWTDVEPVLRATSGEATRELPPMTSIPIDFYPLSALLSKAIVLGVESDLIQRRDVSFSFFRFSIRCTRKTEVRSWRTLFAYLPPPQELFEESLQRGSLKTAGGYLLILHTFDELATASEQSVRLLSRAMREGDWELCKELARFLAALDETGDTLREAMELAKMRVKQESELEDGHGSVGSGLGTMLGVPQGGGANGASSTTSSLISNTKGIIGSDWDADRRTISDAGSVVSANRYLGSQMVDFADLITYLCVVPWFGPTKGSNAVLDPGTRDFGLVDAKRQPTVVRAHFPPTTTFLPSFYAPSIDVVSPAMDDFVSESESDYASYWRDWFISSRGNEYFCEIDEDYITDRFNLTGLNTEVQYYQYALDLITDVFDLDCDDDMRETIEKSARHLYGLVHARYIVTTRGLQKMFEKYKKADFGKCPRVMCSSHPLLPMGLSDVPNSKPVKLYCARCEDIYNPKSSRHAAIDGAYFGTSFHNIFFQVYPTLVPAKSVERYIPRCYGFKVHAAAALVRWQNSQRDEMRRRLRKLEVESGFKDAEDEAELDDDDEEEEEEEEEEEELAAMDEAEGAQQQHAAAAAADEEYWNSEATIGAADEADDEAELPNEPNEPNHWLTPLMSAAARLRRSLRLGEDYEEQAEVEFDEWMEQARYGIF

SEQ ID NO: 23424 - protein, 515 aa, Neurospora crassa
MPNLRTRNPRSLANENDENSTATTTRMTRAKAATLHVDELSMPAKTMQTKKTTISTTTAATAARTVGKRNALGDVSNVTKVEVAGTKKAIAKPGLVSKAAQPSGIQKKTTTATSRTATTARRALSNKEPNKTVGPSAGAGTIPAKRKPPPSTSKLAPIKESAPVENEPARKKIHVEEPEKKKVSRTEAKENDAPSKAVKPMAEPPAPVVRDVVPVQSVYPPGVKDLDTEDLEDPLMVAEYATEIFEYLRDLECKSVPNPQYMSHQDDLEWKTRGILIDWLIEVHTRFHLLPETLFLAVNIIDRFLSEKVVQLDRLQLVGITAMFVASKYEEVLSPHIANFRHVADDGFTEAEILSAERFILSTLNYDLSYPNPMNFLRRISKADNYDIQSRTLGKYLMEISLLDHRFMPYRPSHVAAAAMYLARLILGRGEWDKTIAYYAGYTEEEIEPVFHLMVDYLARPVIHEAFFKKYGSKKFLKASILTRQWAKKNAVLYGVVDAEIPLDKLKDRPVDQLP

SEQ ID NO: 23425 - protein, 595 aa, Neurospora crassa
MTDSIPPTDGKTPDNTCAPLEPRQKYSTTQSPFPDFEFPVEQGNPSYQGEKSSDRHCKEEEEGLSPNQWVASGEQEDNSGSYSEAENVEMSTWRGSPSVKGSTETMRMLLLTCVSVGITFTWGVEMTCVVADQSKSRWGRRRPVIVIGSIITALALMALGFTKEIVAYFIWDPTYARACTIAVAVLSLYCVDFAINADTLPIQKQQSGAAWASRMGSLGHIIGYGMGAIDLLQLFGTSLGDTQFKQLTVIAALGMLVTSSVTCWAVTERVLVTVRPDPRRQSGRFKVVRQIVSTLITLPPRIRAICYAVFWSWIGWFPFIIYSSTWVGETYFRYDVPADTRDSSDALGDMGRIGSTALTVYSTVTFISAWILPPFIRAPEDNTFTHRPPASIASLVETVNKYKPELLSAWIASHLMFAFAMFLTPFAASFRFATALVALCGIPWSIAIWAPTTFLGVEVNKLSGAPDPMSPGATSATNPSYRRLSTSSIEMRFVNEPAAGAVEEVTAGNSSTGELSGIYFGILNIYTTIPQFIATFMSSIVFAILEPGKSPELATDAHPSEHAKTDGPNAIAVCMFIGAISSLVAAYATAKMRDI

SEQ ID NO: 23426 - protein, 280 aa, primary endosymbiont of Bemisia tabaci
MIQNYPETNIEGYIKTVLGFPIISAQDEYDLARRLRNKGDLDAARCLVISNLRFVIHIARSYSGYGLQNSDIIQEGNVGLMKAVKRFDPAHGVRLVSFAIHWIKAEIHEYVLRNWRIVKIATTKSQRKLFFSLRCAKTSLNWLNREEIKSIAKDLNVKPTVVREMECRLSSTDYGFDNKQKEEKNNYKNPSNYLEDSRFDPALQFENFDFERYSYRRLYVALNKLDERVRDILKQRWLNEPKATLHELADIYGVSAERIRQLEQRAIKKIKNYINISTYI

SEQ ID NO: 23427 - protein, 352 aa, Homo sapiens
AAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 23428 - protein, 115 aa, Homo sapiens
GRPCVSKMAAAMDVDTPSGTNSGAGKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 23429 - protein, 617 aa, Homo sapiens
RLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 23430 - protein, 418 aa, Homo sapiens
SCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 23431 - protein, 284 aa, Homo sapiens
AAVNGAAGFSSSGPAATSGAVLQAATGMYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFASQQQKPEDTTIPSTELAKQVIEYARQLEMIV

SEQ ID NO: 23432 - protein, 112 aa, Beta vulgaris subsp. vulgaris
HVIKIKDIILPPEREKFNDVYIVYELMDTDLHQIIRSNQELTEDHCQYFLYQLLRGLKYIHSANVLHRDLKPSNLLLNANCDLKICDFGLARTTAETDFMTEYVVTSWYAPG

SEQ ID NO: 23433 - protein, 302 aa, Xenopus laevis
MDEYTKIEKIGEGTYGVVYKGRHKATGQVVAMKKIRLENEEEGVPSTAIREISLLKELQHPNIVCLLDVLMQDSRLYLIFEFLSMDLKKYLDSIPSGQYIDTMLVKSYLYQILQGIVFCHSRRVLHRDLKPQNLLIDNKGVIKLADFGLARAFGIPVRVYTHEVVTLWYRASEVLLGSVRYSTPVDVWSVGTIFAEIATKKPLFHGDSEIDQLFRIFRSLGTPNNEVWPEVESLQDYKNTFPKWKGGSLSSNVKNIDEDGLDLLSKMLVYDPAKRISARKAMLHPYFDDLDKSSLPANQIRN

SEQ ID NO: 23434 - protein, 324 aa, Xenopus laevis
MALHKDSYVVLSDGHKMPVIGFGTFAPQKVPKNLAEEGVKVAIDVGYRHIDCAFIYGNEVEVGRAIRAKIADGTVEREDLFYTGKLWSTFQVPEKVRPALEKSLKDLQLDYMDLFIIHSPIEFKPGDDPFPLDETGKFIYHNTDIRDTWKALEECKDAGLVRSIGVSNFNHKQLELILNMPGLKYKPICNQVECHILLNQSKLLEFCKSKDIVLVGYSVLGSSRDERWIDQNSPVLLEDPVLNAVAKKHNRTPAQVAMRYLLQRGVVVLAKSYTPARIQQNFQVFDFHLDNEDMRSLDGLNRNLRYVDSTRWLDHPKYPFHEDY

SEQ ID NO: 23435 - protein, 376 aa, Xenopus laevis
MSTVGKVIHCKAAVALEAKKPLVIQQIEVAPPKAKEIRIKIYHSGICHSDDHALGGFMAGIKFPIILGHEGAGVVESVGEGVTSVEPGDHVIAICSPMCMKCPSCLHPDSNFCVQNDVGKNVGMMLDKTSRFSINGKMIHNFMSTSTFCEYTVLDEFACVKIDCKAPLYEVCLIGCGFSTGYGSVLNTAKVQQGSSCAVFGLGGIGMSAVMGCKVAGASRIIGVDINKGKFEIAKKLGCTECLDPNDYDKPIHEVIAEMTNGGVDYSFECVGKVELMASVIQACHFSFGCATIIGVPPSTARLSLDLMWLLTGRTVKGAFLGDWKAKEAFPRLVQDAMKKKFPLKALVTHRVKFDKIMDGFELMRQGKCVRAVLDM

SEQ ID NO: 23436 - protein, 338 aa, Xenopus laevis
MTDQAPFNTDVITLTRFVMEEGRKAKGTGEMTQLLNSMCTAVKAISSAVRKAGLANLYGIAGSTNVTGDQVKKLDVLSNDLVINMLKSSYGSCVLVSEEDPHALIVEPDKRGKYVVCFDPLDGSSNIDCLASIGTIFAIYKKTSDGEPTEKDALQPGRNIVAAGYALYGSATMLVLAAECGVNCFMLDPAIGEFILVNQDVKIKKKGNIYSLNEGYAKYFDEAVTEYLQKKKFPEDGSSPYGARYVGSMVADVHRTLVYGGIFLYPANVKSPKGKLRLLYECNPMAYIMEQAGGMATNGLESVLDIVPESIHQRMPIALGSPDDVQEYMNIYKKYAKK

SEQ ID NO: 23437 - protein, 304 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 23438 - protein, 279 aa, Mus musculus
MQKAGRLLGGWTQAWMSVRMASSGLTRRNPLSNKVALVTASTDGIGFAIARRLAEDGAHVVVSSRKQQNVDRAVATLQGEGLSVTGIVCHVGKAEDREKLITTALKRHRGIDILVSNAAVNPFFGNLMDVTEEVWDKVLSINVTATAMMIKAVVPEMEKRGGGSVVIVGSVAGFTRFPSLGPYNVSKTALLGLTKNFAAELAPKNIRVNCLAPGLIKTRFSSVLWEEKAREDFIKEAMQIRRLGKPEDCAGIVSFLCSEDASYINGETVVVGGGTPSRL

SEQ ID NO: 23439 - protein, 678 aa, Aedes aegypti
MVAHSLQQEVNLSRRACRIPKWPLSGAQQEEENDEEVLEEQLLNGANQSPASEVAAFRLGLVHSENSPGGIDEDPLSFRNRRMHDGRMGSVVDFSCDLVARVFLLVKALVMGVLRFDLTSPKRASSSSSNSSSYGSHFSQNLVKWCTWAIVLSVVLANHGGFVLARPKNGVVTADGVDAASVASGQWELLTPQPVSSDGAVGGQISGSLSSVKQQDDQSHVGELGDASHGEGHEVERYPVAQVEFSRVETPFVIGVWILSASIAKIGFHMTPKLSKIFPESCLLIVVGVIIGVLLRYATNLHVSPLTPNTFFFYMLPPIILDAGYFMPNRMFFDNIGTILLMAVIGTIFNIATIGVSLWACGLTGIFGVDLPFLHVFLFSSLISAVDPVAVLAVFEEIHVNEVLYIVVFGESLLNDAVTVVMYHMFESYNEIGASNIQVVDIVSGVASFFVVALGGTIIGVIWGFLTGLVTRFTDHVRVIEPIFIFVMAYLAYLNAEIFHMSGILAITFCGITMKNYVEQNVSHKSHTTIKYALKMLSSSAETIIFMFLGVATVNNRHIWNTWFVILTIVFCSVFRIIGVLILSAMANRFRIHKLSKVDQFVMSYGGLRGAVAFALVLLVSTDHIPLQPMFVTNTNAVIYFTVFLQGITTKPLVRVLNVKRANKRKPTMNERIHERVS

SEQ ID NO: 23440 - protein, 1179 aa, Aedes aegypti
MVAHSLQQEVNLSRRACRIPKWPLSGAQQEEENDEEVLEEQLLNGANQSPASEVAAFRLGPVHSENSPGGIDEDPLSFRNRRMHDGRMGSVVDFSCDLVARVFLLVKALVMGVLRFDLTSPKRASSSSSNSSSYGSQFSKNLVKWCTWAIVLSVVLANHGGFVLARPKNGVVTADGVDAASVASGQWELLTPQPVSSDGAGGGQISGSLSSVKQQDDQSHGGELGDASHGEGHEVERYPVAQVEFSRVETPFVIGVWILSASIAKIGFHMTPKLSKIFPESCLLIVVGVIIGVLLRYTTNLHVSPLTPNTFFFYMLPPIILDAGYFMPNRMFFDNIGTILLMAVIGTIFNIATIGVSLWACGLTGIFGVDLPFLHVFLFSSLISAVDPVAVLAVFEEIHVNEVLYIVVFGESLLNDAVTVVMYHMFESYNEIGASNIQVVDIVSGVASFFVVALGGTIIGVIWGFLTGLVTRFTDHVRVIEPIFIFAMAYLAYLNAEIFHMSGILAITFCGITMKNYVEQNVSHKSHTTIKYALKMLSSSAETIIFMFLGVATVNNRHIWNTWFVILTIVFCSVFRIIGVLILSAMANRFRIHKLSKVDQFVMSYGGLRGAVAFALVLLVSTDHIPLQPMFVTTTIAVIYFTVFLQGITIKPLVRVLNVKRANKRKPTMNERIHERFMDHTMAGIEDIVGKTGNYNIRDKFKRFDNRFIRPYLIKNLQGPEPKILETYSKLTMRDAMDYMRRNPSTIGQMSGTESMSALFRNYTGVFGGSPSFSNLENSTRNLDMQELDYNPSKKDLTDARIHHLLSVELKPYRRTRRLSYSRHAVDDRDLSTQVNYKMQMNIRRMISEKKHKRSKRGKDGKTQNHVSFPELPQNGSAKQFANDYINEVLHEDNEDEDKLPTAAGDDWDGGGLTFTAKSSLDEKSEQPKNDKRMSKDLRDLEAAENRVTTPTAIEAVLPWKRVDEDDENGAIKQNEFPSWASNKEYLAYNSPSATFLGGLTQPKQAKSVIGLFRRESSGSGGIVIGGVTDSETSTPVTATTPIGRVKKDKRSASIAGYITFPGSSDAGDDPLGVSRAVVSHANAFPVTASHRRNNRRGSLLELSGEAIPEENYSKSLPDRDKHGPRRGPTLIKASGTPKPARNSKSNNPQTTALLSSSSTDSEEEEEEDEDCTDEQHPI

SEQ ID NO: 23441 - protein, 723 aa, Danio rerio
MGKKKQEEEQNSSEYGAPAQYDPTFNGPIHKRSCTDIICCVLFMLVITGYMVVGILAWLYGDPRHVLYPRNSTGMFCGIGQNQNKPSVLYFDILKCATATNIMAAALQGLQCPTTQVCVSSCPSGFWALSPLAYLPNAKPADYFQQELCVPSLQLKDTTYTVMEIINKELCPYYYTPTTSVLDRCLPSLGGSAYNPSNIPANFSLPGLSINQTLSTIANATSDLTNSFNMKDVGLRIFEDFAKTWQWIVAGLVIAMVVSVLFLLLLRFTAPVLIWILIFGVLAVGAFGIWYCYNDYMSLASSNLTFSNVGFTTNVQVYLQVRDTWLAFLIILCIVEAVLILALIFLRTRILIAIALIQETSKALGHMMSTLLYPVVTFVLLLVCVSYWGITALYLATSGAPIYKVVALNTTQGDCSNIQANQTCDPQTFNSSRYSSCPSARCVFINYNTEGLFQRNLFNLQIYNVVAFLWCVNFVIALGHCTLAGAFASYYWAFSKPADIPTFPLTQSFMRALRYHVGSLAFGALILTLVQIVRIILEYLDHKFKAAQNPCARFLMCCLKCCFWCLEKFIKFINRNAYIMIAIYGKNFCVSAKNAFFLLMRNIVRVVVLDKVTDLLLFFGKLLVVGGIGVLAFFFFSGRIQLPGNTFQTAALNYYWMPIITVVFGAYLIAHGFFSVYNMGVDTLFLCFLEDLERNDGSAEKPYFMSKNLMKILNKKNKQPKTG

SEQ ID NO: 23442 - protein, 512 aa, Danio rerio
MNVGELSAAFTAVPTHKSVKKIQFANQEDKQEFSKFPTKTGRRSLSRSISQSSTDSYSSAASYTDSSDDETSPREKSQVNSKGSSDFCVKNIKQAEFGRREIEIAEQDMSALISLRKRAQGEKPLAGAKVAGCTHITAQTAVLIETLVALGAQCRWTACNIYSTQNEVAAALAESGVSVFAWKGESEDDFWWCIDRCVNMDGWQANMILDDGGDLTHWVYKKYPSVFKKVRGIVEESVTGVHRLYQLSKAGKLCVPAMNVNDSVTKQKFDNLYCCRESILDGLKRTTDVMFGGKQVVVCGYGEVGKGCCSALKALGAIVCVTEIDPICALQACMDGFRVVKLNEVVRQMDMVITCTGNKNVVTREHLDRMKNGCIVCNMGHSNTEIDVASLRTPELTWERVRSQVDHVIWPDGKRVILLAEGRLLNLSCSTVPSFVLSITATTQALALIELYNAPEGRYKQDVYLLPKKMDEYVASLHLPNFDAHLTELSDEQAKYMGLNKNGPFKPNYYRY

SEQ ID NO: 23443 - protein, 207 aa, Danio rerio
MSRPSSAGGAAGGLGAGKAGGSKHGGSGGTTASAAAAAAAAAAAAAAAAAAGVSGSVAGSGTVPAAAVALPVAALPGQSPELTALFECPVCFDYVLPPILQCQAGHLVCNQCRQKLSCCPTCRGPLTPSIRNLAMEKVASTLPFPCKYSSAGCLLSLHHSEKPEHEEVCEFRPYTCPCPGASCKWQGSLEEVMPHHVQSMTVLQRPS

SEQ ID NO: 23444 - protein, 280 aa, Propionibacterium freudenreichii subsp. shermanii
MIIPTTPTPTVELSGGTRMPMLGMGTWPLKGEECRAAVASAIEQGYRLVDTAEAYGNEEAVGKAVREAGPDRAEIFVTTKFSKQWHSRKGVHEALEHSLERLGLDYVDLFLMHWPMPGEGSYVDAYRGMVELKEQGLAKAIGVSNFKVHHLDDLITEGMTPEVNQIQLDPSRPRLEVRDFLDNHDIVTEAWSPLGRGADGVLNAPAVLDAAKKHGITPAAAVLAWELNQGIVTIPKSANPEHQRTNLEAIGVELSAQEMKAIDALADPNAKIDDSDKTGN

SEQ ID NO: 23445 - protein, 271 aa, Malus x domestica
MGRGKVQMKRIENKISRQVTFSKRRSGLLKKAHEISVLCDAEVAVIVFSTVGKLFEYSTDFSMVRILDRYDQYSYAERQRTGADSESQENWPVEYPKLAARIEVLQRKLRNLVGEDLDPLSLRELQDLEQQLDTALKRIRARKNQLVHESISEMDKKRKALRELNKSLAKKVKENKTMLEEEHDQVQVVGQQQTNQGRHNSSTLMLMPPPPQPPSTPTLPTFRTTRKSCSGGVQARGAVDDNDSDKGGRPPPRPAAATNTRMPLWMLSPFE

SEQ ID NO: 23446 - protein, 247 aa, Malus x domestica
MGRGKVQMKRIENKISRQVTFSKRRSGLLKKAHEISVLCDAEVAVIVFSTVGKLFEYSTDFSMVRILDRYDQYSYAERQRTGADSESQENWPVEYPKLAARIEVLQRKLRNLVGEDLDPLSLRELQDLEQQLDTALKRIRTRKNQLVHESISEMDKKRKALRELNKSLAKKVKENKTMLEEEHDQVQVVGQQQTNQGRHNSSTLMLMPPPPQPPSTPTLPTFRTTRYDLSLSLSLSDVSVKQYAEGE

SEQ ID NO: 23447 - protein, 332 aa, Caenorhabditis elegans
MNLPSKFHQVTITDPIAGAGITFTIPTRYVNLKFLNVGAQGIVVMADDLVTTQRVAIKKMQQPFLLTMSARRAYREFILLTTLKHPNIIRLLNAFTPDTSLSSFQEVYLVMEFMTHNLHEVIHRLRLDHETLSFLVYQSLCAIKHLHNLGFIHRDLKPSNIVVNERCVLKVLDFGLARRRNVDMRMSDYVGTRYYRAPEVILGLNYSEKVDIWSVGCILAEMINHTVLFPGKDIRDQWTQISSVLRTPDDHFINQLEPIGAVYVRSLPQHLARAFNEIVPDSNFLPETENPKDHLTLHMARDLLFNMLKINPEERYSVEDALNHPYTMVQGR

SEQ ID NO: 23448 - protein, 302 aa, Caenorhabditis elegans
MALNFWKSSHCQQWIFDKTEIWKQRAEDMKIYNEEEYNRLNIFWANFITAVATEGAHSQANVGCKLRQQVIATAIIYFKRFYLRQSFRDMCPFLVASTALFLACKVEEHTTLSVSSFLKNTAIVLPKRWGVTFETTSTKNGVVYDSEFILVEILDCCLVVHHASRPMFELLEDLKQFTQQSTIANQPIKDLEAIEAQCQKVANDSLRCDVSLIFPPHVIGLSSIMVAMELMGRGEELEAWLVEVDTDFEKVTDCVEQIYKMYTLWKSFDEKEEVKKLMAKLPKPNQQPPPQQQHQHQQGYHL

SEQ ID NO: 23449 - protein, 514 aa, Capsella rubella
MDNSRTRQNMNGSAAATNWSQQNGRTSTSSLEDLEIPKFRSFAPSSISISPSLVSPSTCFSPSVFLDSPAFVSSSAHVLASPTTGALITNESNTKLINEGEKKDNNINFFDFSFQTQSSGVSAPTTTTTTTNNSSIFQSQEQQRKNQSDQWSQNESRQNNQAVSYNGREQRKGEDGYNWRKYGQKQVKGSENPRSYYKCTFPSCPTKKKVERSLEGQITEIVYKGSHNHPKPQSTRRSSSSSSSTFHSAVYNASLDHHRQASSDQPNSNNSFHHSDSFAMQQDDNTTSDSVGDDEFEQGSSIVSRDEEDCGSEPEAKRWKGENETNGGNGGGSKTGREPRIVVQTTSDIDILDDGYRWRKYGQKVVKGNPNPRSYYKCTTIGCPVRKHVERASHDMRAVITTYEGKHNHDVPAARGSGYATNRAPQDASSVPIRPAAIAGHSNSTTSSPAPYTLQTLHNNNTNSTARSWLRYDNNNNNNNNNPQTLQNCVCGDAFSRATEEPNEETSFFDSFMP

SEQ ID NO: 23450 - protein, 406 aa, Micrococcus sp. 28
MAAESTGQAGVSPAPTVSPAAGAAPPDSSGVSTPPDASPAGASSLPEVPAAPPAEDAPAPSPEPDSPPRPETAPAPEATALLGDAAAIAPAPAGRSAAFPSLAAAEPLAPPATAPPWPTPVWEAPSPDLSFEFRGRTPGAAALADWPPAAGATPAAARPAAVPARAPLIGDAPPAAGLTPAPESSPSLASTRSTVPSTPPAPVPAAEVPPAAPVPWSENSAEDAPLPAAPAAPLSALLPAAPAAPLSAPPLAEPPAAPGSLPAPFAPAVSPEAVAPAVPLAPPAVSAAAPPPARPPPGPAAPPPPAAALPPPPAAPPARAAPAAAPAPAPPVPARMAAPAAMPRAAPATPAPENPPRPAPTTGDRNRIRVGRTSPAIPSRRMPVIAEESRTPKSSEVLVSSMNPNA

SEQ ID NO: 23451 - protein, 319 aa, Ruegeria sp. PR1b
MMLEISKRNARMWSRMGIRAFYGQALSAIASENPNVLALSADLGRSSGLDRFSKEYPAQFLNTGIAEQNMVGVAAGLARTGFDVFASTFAPFASMRAAEQVRMNMGYMHEPVKLVALGSGLAMGFLGNSHYGLEDLAVMRAIPGLTVVSPADCAEIYKVLLACVDYAHPVYIRLTGAINCPVFEVNLFGPLLFTQSVVKKMLRAKQGSVVNIASTAGLLADAGTLSYGGSKAALIHATKVMARELGSFGIRVNAIAPSVVETEMATQMDASARAALDARSALPGAIEPGDVADLAAFLISEQSARITGQVMRIDRGLPF

SEQ ID NO: 23452 - protein, 273 aa, Bacillus subtilis subsp. subtilis str. 168
MGRLENKTAVITGAATGIGQATAEVFANEGARVIIGDINKDQMEETVDAIRKNGGQAESFHLDVSDENSVKAFADQIKDACGTIDILFNNAGVDQEGGKVHEYPVDLFDRIIAVDLRGTFLCSKYLIPLMLENGGSIINTSSMSGRAADLDRSGYNAAKGGITNLTKAMAIDYARNGIRVNSISPGTIETPLIDKLAGTKEQEMGEQFREANKWITPLGRLGQPKEMATVALFLASDDSSYVTGEDITADGGIMAYTWPGKMLIEEKWKEETK

SEQ ID NO: 23453 - protein, 171 aa, Vibrio cholerae
ICGTAGVALLVLTPNAALDPVGVAAGLAGAVSMAFGTVLTRKWQPPVPLLTFTAWQLAAGGLLLVPVALVFDPPIPMPTGTNVLGLAWLGLIGAGLTYFLWFRGISRLEPTVVSLLGFLSPGTAVLLGWLFLDQTLSALQIIGVLLVIGSIWLGQRSNRTPRARIACRKSP

SEQ ID NO: 23454 - protein, 257 aa, Pseudomonas putida
MSNQFNGKKLLVVGGTSGMGLETARQFLSEGGSVVIIGNRPEKTEEARKDLSAQGNVTALTADLTSDEGLAKLIKTISQQHSDIDMLVNAAGVFFPKPFLEHQDADYDQYMKLNKAFFFITQKVTANLVEQNRPGAIVNIGSMWAKQAIAATPSSAYSMAKAGLHSLTQHLAMELASKNIRVNAVSPAVVQTPIYEGFIPKAEVHSALQGFNSFHPIGRVGTPQDVAGIVVFLLSEQASWVTGAIWDVDGGVMAGRN

SEQ ID NO: 23455 - protein, 291 aa, Yersinia enterocolitica
MLMKNFLVILLFIMVSVTWGTTWLAMKLTVETIPPIFATGIRFMLAAPVLILISVLTKTRLLFPDGQKFFQLFVCIFYFSIPFSLMIYGETYISPALASIIFSSMPVCVLFFSWLLLNEKVGIIAILGLVTSTVSLLAILFIETNIGNNNQWVGIISLVISVIMHALVYVQCKKRSCSISVLTFNAIPSLVAGILLCIVGWIAEQPVISKFSQQSLLSVIYLGIIAGVFGILCYFQLQNKASAFQASTVFLVFPIIALLLDGYVYGRYFSLYSILLIIPLLTGVLLISLRK

SEQ ID NO: 23456 - protein, 282 aa, Solanum bulbocastanum
MDRMYSGGGDMGYGYENGVVMTRDPKPRLRWTADLHDRFVDAVTKLGGPDKATPKSVLRLMGLKGLTLYHLKSHLQKYRLGQQTKKQNAAEQNRENIGESFRQFSLHSSGPSITSSSMDGMQGEAPISEALRCQIEVQKRLHEQLEVQQKLQMRIEAQGKYLQAILDKAQKSLSTDMNSPSAVDETRAQLTDFNIALSNLMDYMHGHNGDETSAGERTQDDTNKDLQRSTYLTEGEQKKIMNIKLEETSVSFDLNSRSSYDFIGMSSAALEAKHFSNGRLEI

SEQ ID NO: 23457 - protein, 761 aa, Solanum bulbocastanum
MKSLANSIFILILTLFFSHTCIINLLSVAAITSLKPGDELNHSQVLDSEGGKFKLGFFSISQTNNYYLGIWYAGDPQDKKLWIANPNTPLLNNSGLLTIDTTGTLKITSGGKTVVNITPPLLTRSSIARLQGSGNLVLQDETQNRTLWQSFDHPTNTLFPGMKLGYNLTTKQNWTLTSWLSSYIPASGAFTLSLESIQDAFQLVIRRRGEVYWISGAWRNQSFPLLTALHDSSNRYQYNLNLVSEKDGVFFQFDAPDGSFPSLELNFNGAIVGGGEDSRVYALYNEFCYGYESQDGCVSNQLPECRKDGDKFEQKSGDFIDRSKNSNSYDNASTSLGDCMKRCWEHCSCVGFTTTSNGTGCIIWNGNGEFQVDESGNTVKKYVLVSSKSSNAIVVPMLISGFICYSIVRRRKLQAEKRREEEYIRELTASDSFNDTNMKEKDGREVQDLKIFSFGFVLAATNNFSSENKLGEGGFGPVYKGKFPDGREVAVKRLSRTSGQGLVEFKNELILIAKVQHTNLVRVLGCCIHEDEKMLIYEYMPNKSLDFFLFDPERKKLLDWQKRYEIIEGIAQGLLYLHKYSRMRVIHRDLKASNVLLDENMNPKIADFGMARIFKQNETEAVTARVVGTYGYMAPEFAMEGAFSIKSDVFSFGILMLEIAWELWKEGCALELKDPALGDLCDTKLLLRVIHVGLLCVQEGATDRPTMSDVISMLGNESMPLPTPKQPAFFTGRNETESHSAGIKAEQYSVNDCSITVIEAR

SEQ ID NO: 23458 - protein, 993 aa, Pirellula sp.
MISLYQRIPIRIRISLGLVGLMAGSLLVASAAGFFPNEQEEILHGRARLCETLAISGTAMASHGQVDSLRVTMESVVHRDPQILSIGLVSSEGQLLVSAGEHTEFWDDSLEDDVNQMKVPVFRYGKQWGEMQFAFASTGGLFGLNYWAPAWLLIVLIPACLIQFSFFLKKTLESLDPSGAVPTHVENALDTITVGLVLLNSKGRILFTNRRLNQLLSQESADLMGKKIDDLEWQMIADTGAVLPWEEAKQNDDSVMDRILQFDNNGRMLTFSVNCTPIAGQGYLVTFEDITLIEENKVALAKARDAAENANAAKSDFLANMSHEIRTPLNAVLGFTDVLRRGLVSNGDEAVDHLNMIHRSGAHLLELINDILDLSKIESGHLQTETIDTSLDDIVTDVANTLKVKADEQNLALKVDFRTAIPRTIQSDPTRLRQVITNLVGNAIKFTESGSVSIVTSLLKTPSNALEGYDPIIRVDIIDTGIGMTPDQQAKIFDSFVQADSSTTRKFGGTGLGLSISRRLAEAMGGSLTVHSEVGIGSTFRVELPTSIASLQDMVSPEELARLAQEKSAGSVSSELLRLPGKRVLVVDDGEANRRLIELVLKRAGATVMSAENGQEALDMIAEGNESGYPYELVLMDMQMPVLDGYSATRLLREREDTTPVIALTGNAMRGDREKCMDAGCDDFLTKPVNLDELLEMVSQYLGEVDPGTLLNTKTMANETSSAASLSSAGILPSMQTPVSAASASLSSSGSPAAASSGLPSSAIVPTLPMDDEDFRAIAGDFVSRLHTRLDGIEQAIQESKFDFVHGEAHWLKGAGGTVGLDVFTEPARTLEQAAKDGSPDIAQSILNDIRELHGRVAIPGMDLSKESNQSDSLSPAIASVDPATIINPIHCALPLDDPDFHAIVSDFIVRLDQRLVDMRNELRDQRFDALELSAHWLKGAGGTVGYGDLTQPSRDLIDAALAANPADCETYLSQIESVRARMILPEPLPQSV

SEQ ID NO: 23459 - protein, 252 aa, Pirellula sp.
MDLSLSVDLKDQVAIVTGASQGLGRAVAVALGQNGAHVVCVARNAEKLAATVAEIEAAGGKGEALPCDVTDRKAAAEAIEGTHKKHGRLDILVNNAGITRDKLMRGMSDEEWDSVIATNLTSCFVCCRSAAGVMRRSKYGRIINMASISGLIGNPGQANYSASKAGMIGMTRTMSKELVSRGVTVNAVAPGFIASEMTAELGEVVLEEVKKRIPAKRVGQPEDVAAAVLFLASRDASYISGQTIVVDGGMVG

SEQ ID NO: 23460 - protein, 218 aa, Pirellula sp.
MSQSDNNTASILSPNELGQLHLDIAIAHDLTERYEGLIFDCDGTLTNSMPLHYLAWNETMTRHGIDFPESRFYAMGGMPSEKIIAVLSSEQGVSIDVDLATEEKEANFIARIPSVERLEHVTDIAERHLNRIAMSVASGGMRDIVADQLRTIGVADWFPVLVGSEDTELHKPEPDVFLCAAERMGVDPKRCLVFEDSPLGFEAAKRAGMDWVDVRVDA

SEQ ID NO: 23461 - protein, 981 aa, Pirellula sp.
MRFTFFLLLLAITALSSLQAREWTDATGKYRIEAKLVVVHGDKAVLERPDGKIISIPIAKLSDADQTFLKELAAKSAGPNRTTNRPADRKPSAASPNSASTLNVSPKDLAVQTELLLRDACHRCHGEDGTSEGGFNFVVNLGKLVKTIAVPGEDSQLLERIQADDDSVMPPSGEEPRLSERDIQVIEQWIAAGAPIFDDEPTRPFVSNEQLVQWIDEDLQKQPERSQRFMRYFTLTHLYNSGVSEDELQTYRNAFAKLLNSLSWNADLIIPEAIDSARTVFRLDMRQVHWTQTIWRSIEEANPYFLMPRTPHAESCFDRTETTMPFVRVDWFVFAASKPPLYHSVLNLPETDADLENMLRVNVQANINQEMAIRAAFNRSGVSQNNRLIEWHKSPYGSYWKSYDFASNTGRQNLFEYPLGPSHRRDSFKHDGGEIIFTLPNGLQGYLLTDEQGLRIDQGPTQIVSDPKQPDRTVTNGVSCMSCHYAGMIPKRDEVGPAVQANRSAFDDADDILALYRDASELDRIMDQDAKRFADALDDLGITTLSRSGESISAMSSRFIQDIDLEQVASEFGLQVEEFLERLQDASRVARIFSSLQISGGTIKRDVFKEMFADACVDLQLIEANVVSRPNRSNPSVASISKPRSASSTVSGNPMHAAGDAKSNTPAARPPNGITEPMKVGSKLVPVAKFSDLSWGVKSLAIHPNQNVVAAGRPDRKITLFNIDHESVLGELTGLDMLQAVTACAFTPDGNHLIAGGSSGHIVIYSVTQKGLLRPSGQFPGHNGEIQCIDISSSGRYALTGDGKKVARCWEIATGKEISMIGNFEGPVKAVHLSADERTMFATDGATLVEADMHTGSPISKRPLNRSWASGQSAAFSPDGAWLAVADTYNIRVWDLNTFRELEPLIGNETLWTMCFAPDNQHLFAGARGKVDVWEFQRNARLQRQSIERGYIQSLAVSADGRHFAAVGSIGGSLEVFSRDK

SEQ ID NO: 23462 - protein, 1170 aa, Pirellula sp.
MFVASLTNNVNWRHAKREPMMEEDRSAILIAESNDQRRAHLKQVLDRQHDLVTVDGGKSAWQQLTQGRFDAVVAGFDLREVSGVKLLAQTRAHAELRGVPFVLVADEASPIDPTTWQQVFEFGRSDILCSPINEHELLARVDSIIRRARVKNESADMLQRQKSRLQMALLASRMVAVEWDISADTVLYSENAIEIFGIKSLSDHATGPTARKLVHPDDIDTVEKTIRNTLQGSREFQTQFRIIRPDNGEIVWIEERGYVATDASGKPTKLIAVAVDITARRNAEQAIQEREHYLQAIFDTTPECIKVVKSDGTLTQMNAAGLKMIEANPTANVAGNSVYELIAPEFLDCFREFNERVCSGHSGVLEFDIIGLRGSRRHMETHAVPLSLTSGETVQLAVTRDITERKRSEATLRENERRFRALTQATSDIVFRMNADWSEMGMLEGRAFIDSTTEPSRSWLDHYFHPDDQTEVRKVVQNSVEKQSFYELEHRVIRIDGTLGWMHSRAVPILDDAGNVVEWFGAGTDVTERKQSEEFQHRATQTLLTVIEQSPLGIYLVDGDFKIAQVSLGAGPAFQNVQPVIGRDFEEVMHTIWPPEFASEAVRIFRHTLKTGEPYVSPGLTEKRKDLGETESYEWQVNRITLADGSYGVVCYFFDTTRLQQAADALRESEVRFRMLADNMSQLAWTCCDLGECNWYNQRWYEYTGCTFEEMQGWGWRQVHHPDHVDRVVERIQRAATAGEVWEDTFPLKGRDGQYRWFLSRAVPIRDEEGTIVRWFGTNTDVNELRETQQLLHDADRRKDEFLAMLAHELRNPLAPIRSGLDLLAIADDDEHRDVVRVMQEQVTHVVRLVDDLLDVSRIMRGKVELRKERIEFQSTVRKAIDAVRDVIESHGHSLTITLPEKTVWLEADPVRIVQVLENLLSNATKYMDGSGAIELSASVKNESLFIQIKDEGIGIDQEFLPNIFELFAQSDRSLDRSKGGLGIGLTLVKQLLEMHGGNIHAESDGLGKGSSFHIELPIASPPEPNQNVPLELQSDGQTRRIAVIDDNRGAVLLLSKLFEKLGAHEVHTANDGEAALKLIREVHPEIVLLDIGLPSLSGYEVAAAIRQDPQFDDILMVALTGYGQDQDRLKSEAAGFDEHLVKPPSIDQMRFVLAHPKLKPSGKGNGGQS

SEQ ID NO: 23463 - protein, 105 aa, Pirellula sp.
MILIQAIIQPTKLSNVQSALDEAGFSDTIVGDALGYGRQRGQTALFRGNEYKIDLLRKVTFEMVIDDDDLEPVVEIIRNASRTGTEGQIGDGKIFVLPVANVIDI

SEQ ID NO: 23464 - protein, 890 aa, Pirellula sp.
MTATMAKKDKMVYYFGKTKTEGKGGSKAILGGKGLNLAEMTSIGLPVPPGFTITTEVCDGYYKAGKKLPKGLMDEIQDAVKILEKELGKNFGDNENPLLVSVRSGAAVSMPGMMNTILNLGLNDEATEGLAKATKNERFAYDAYRRLINMYGDVVMGLHHEQFEAAFDKVKKKHNVTEDTEVPAEGLRELCEAYKAVYKKGTGEDFPQDPIKQLQLAIEAVFGSWNADRAISYRRIESAKGNTEINNLIGTAVNVQAMVYGNMGDDSGTGVGFTRDPNTGQNKFYGEFLINAQGEDVVAGIRTPQPVAQMAKWDKAAHKELMEIKKKLEDHYTDMQDIEFTIERGKLFMLQTRNGKRNGIAAVKIACDMVKEGLITEKEAVLRVPASDLTHCLLPSFKPTARNAADVLCRGLNASPGAAVGKLAFTAPEARERFEAGEDVILVRRETSPEDVEGMSAAVGILTSTGGATSHAAVVARGWGKCCVAGASEVEINEKGKTITVGGRKFTAKDTISLDGTTGEVMAGEVETQEPKLSGDFAKLMEWADQYRRLSIRTNADSPADSKRARDFGAEGIGLCRTEHMFFEADRIIHMRAMILAEDEDARRAALKKLLPFQRKDFEGIFKAMKGCPVTIRLLDPPLHEFLPHEAAAQKQMAEELGVKPAEIKKRGEALHESNPMLGHRGCRLSVTYPEILEMQVQAIVEAAISCAKKKIDAQPEIMIPLVGTAAELRILREKVEETIEATKTAKKFEGELNILIGTMIEIPRACLTADEVAEYADFFSFGTNDLTQMTFGYSRDDVGGFLPDYIEAKIVPVDPFQSLDTSGVGQLVEMGVTKGRSIKKKLKVGICGEHGGDPASIEFCNSVGLDYVSCSPFRVPIARLAAAQAALKA

SEQ ID NO: 23465 - protein, 635 aa, Pirellula sp.
MTDQKHPLLAGLQDATPLANWSSTELSNAAVEIRDVLCNLLATRTAHFASNLGVVELCLALHSEFDFRTDRLIWDTGHQVYPHKLVTGRYDRFETIRTAGGLMGYPNPHESVYDLFMTGHAGCSVSTAVGLRSGDILMDQKDRRTVAVIGDGAFPCGVVFEALNNAGELGDDLTIILNDNKMSICHRTGSVAQYLDRLRGNPFYTGLKHEVTKLLDRVPMFGDPAERLLAQMKEGVKAGLLGGMLFEELGIRYIGPIDGHDIPLMQKYLRLCKETPGPVLLHVVTEKGHGYKPAAEDPVFFHTPPAFEDRGGTPVTRGSDGRPPYTTHARDAIGEAMKRDSRVTVITAAMCQGNKLEPVREQFPERFFDVGICESHAVAFAAGQCKTGMRPIVDIYSTFLQRSYDQIFQEVALQDLPVVFMMDRAGLTAPDGPTHHGVYDIGYMRLFPNLVLMAPGYAEELSMMLDKALTLDHPSGIRYPKASALEATHTPAPIEIGKAEWIREGTDGTIVAYGAMLEQAIAAAEQLEGELEIGVVNARFVKPIDAEMVHKTLSDGRFVVTLEEGTRVGGFGSAFLESAVDQRLDTRAVHRLALPDEFVLHGDRSQLLDQSTLSAQKIAEVCREAASEVGSQVGI

SEQ ID NO: 23466 - protein, 438 aa, Pirellula sp.
MSPSLFFAAIFCGSCFLLFVGSADAIEEWEWKRLTRKRLPKLRSGKAIDAVSAKLADQSASAAKPDVTNHPSRWKGWRSASVQSVKDESLDCRSFVFVPTDGEPFPPFLGGQYLTVRLKDPSSGKNVSRCYSLSSGPDEPHYRITVKRVPGGTMSNLLHDTIDVGDRIEIQAPKGRFHYSVEESQSANLEPLNLVAAGIGITPMLSMLFQSLNERTDRDVNLFYQVRNAVDAPFLAPIREIAKMLEATTGVRVHLWFSKPEDDDLRPGDSVGRLSAERIVERLGHHRGEYLICGPDVFMNAIAEGLIECGASADRVMFESFGGKSKSAGALAVPACDPCSDASDVDESNSDDSVGWNVTFQTSGKSASFEAGMDGLLDVAESLDVDVDSGCRSGDCGACVRRLLSGEVRYAETPECDVEDGEAVLCVAKPVSEVVVDA

SEQ ID NO: 23467 - protein, 133 aa, Pirellula sp.
MTWRVYNVLKFSVRMFVGAAPVKKVEAIVRHFKLEDVKNALTEQGIHGMTVSEVRGFGRQKGHTEIYRGTEYAIDFVPKVKIEVVCTSDNLQTVIDTILQTAQTGQIGDGKIFVTNLEESVRIRTGERGEEAL

SEQ ID NO: 23468 - protein, 1998 aa, Pirellula sp.
MSSLPPNDPDAISTQRYNVQKKLSNASVVSCFSAIDTATGGKVILREVPKVFFQERGFHRFKTESRLTSGIHCETYSRPIDFMVGETHLRVVYPYVEGVSLARKFRKRPLTATEAMLLAKDLFEALEQIHQIGCIHRDIRPSNIIVREDARSVLCGYVPLWCPELFGKDDLLARECATYTSPELSGIIDHDISETSDLYSVGHVLYAALTGVPAFAGDVSEILYRHMTADPDTGCYPDETPSVVIALVEKLIRKEPRDRYQSASAVLDDVKTILHQLKTGGVADDFVIGNTDKRTVVIDPAFVGRDEHVRTLEKSLDNVLEGRTERVLLRSESGMGKTRLLNEVSRLASRKRFLVLRGRSLPDANQQPSAIWLQAMDQLVKHLTNDPVMLERTRERMEPYRQEVTTALPALAKAFGWGNAKLSGPDEFGQGRIVSAFRTLFTELGTPETSVMITLDDCQWMDDQSFRILQAICECPARHLFLFAVTRPSEGLCTRLNDELSFPIKLELGPLTDQAVQQLAESMAGQLPTEAIEVVQRFAGGSPFMASAIVRGLVESSALRPADKCWVVDDAKLSSFQAADDASEILVDRLTRLPVETRELLTAAAVIGRDFNLEVAAELVGIRLADAHRAIHPARVQRLVWSRPDRVLAFVHDKIRESILEELTADRIRSMHGQIGQYYVEHEPLEFFKLAYHFDAAELHEQALPFALRAAEIARNSFSLVSAEEQLRIATRAICHADRSKQHHIQMMMSDVLMLQGEYDKSEAWLDQAFESAETGTHNARVLLKRGELHFKRGSKNLAVECFEASLRQLKQPVCNNRLSLMARIALEGARQVRNSLLPCFVGRQCGQPSEEEQMSLSLYSQIAHAYWYTRDKYYTLWAHLRSMNAAERFQPTRYLAQSYSEHAPVMTLLRWEKRGVEYARRSLEIRKAFSDVWGQGQTRNFLSILLLSFSRYEQCVEQASQAVKMLERTGDYWEVHIARYQLAASLYRLGRHKEALEQSRINFESAMRRGDYQATGNIIDVWARSTNGDIPEEIIENELARDLADSQRMSQVLLAKGVREFYQERFAEAVGSFSRAIAVAEDTRVSNTYVSPAYPWRCTAMRRQLETSIPRSTQRRWKSIGELGRATRKAVAVSKQFTNEIPHAYRERGAYLALAGKLRASQACFQKSLQVAEAQGAMVAHAKTMILFAEYAAEFGWPIDGDAIEHARGTLSELECSDYDVNEGGSLSLVNRFDSLLASGRRIATSVLPEQIYQEVRRAATKILRGEQVFLITRTEDERLSTVPAGMPFDPAIVNEVDRTRQTVVADVENAVSNGITTTKQGTFLCSPVDVNDQTLSYLYVSNERFSNLYDDDEIRIADYLTSAAGAAMEKANSFQQLQDLNLNLEKKVHERTESVVRHSKELELTAQQLTATKEKLQIAKTAAEEANQAKSEFLARMSHEIRTPITGILGFTELLLRGVVTDDAERESHLQTIHSNGFHLLHLLNDILDISKIEADKIETERVLCNPSWMVQDVIASLRSKAIEKDISLEIQVDSEFPEEIYSDPTRLRQILTNLTSNAIKFTNQGGVTISISAIGSGETASKMKIAVRDSGIGMTQEQTAFIFEPFKQADVSTTREYGGTGLGLSISKRLAEALDGTLEVESERGVGTQMILNFDIECPSGVRMLSPAEVLLPYNGVKENQFDVVDLAGVRVLVVDDCETNRRLLSLLLQDAGAEVDIRCNGREAVDALRSDPSMVDIVLMDMQMPVMDGYTATSALRAQGFQAPIVALTANAMTGDEVRCREAGCTDYQTKPLDLNALLQCVAENTVGEKANVSSIVAVQENPPVIEEAASPIELSSQSVGQGEPLAESSEMLPDDHEQLEVALNEEHEPLNDEDETTKEKIFNYDWLHEFACDLIDQLDETMPSIINAYDRGDLEQVGKHLHQIRGSGGTVGLLQLSEIAAKGESAIEVSQWEQLRNTLTELQSYVSDALEEKSSSSESVSNNSLDPSADIDR

SEQ ID NO: 23469 - protein, 314 aa, Pirellula sp.
MTDTMTRPKITVVGSANVDLTFRTPRLPVPGETFAGHSLHQGMGGKGANQAVVAARLGAEVAFVARVGNDGFATQAIDAYQTDGINTSFVQHSKDQPTGTAAILVDDDAENCIIVVAGANAELNADDVRSAKDVIAFSDVVICQLETPVEAALEAFKLARAANVLTMLTPAPAELVSDELLSLCDVCVPNKTEIAAITGCSVETQADCAAAAEQLRQRGVRQVALTMGGEGVLVLDRSGMSLIPASPVKAVDTTGAGDAFTGALAVSLAEGMSLADAATRAGIVAAISVTRVGTQTSFPSLDEINRWKQAENTA

SEQ ID NO: 23470 - protein, 262 aa, Pirellula sp.
MDLRLNDKTALITASSGGIGMAIAKRIAAEGATTIINARSTSSVEKAINEIQKELPDAKLVGLVADNGTAEGIATTTDEHPNVDILINNLGIFEPVDFFDLTDDQWNEIFEINVMSGVRLARHYLKRMLDQNSGRIVFISSESAIVPSPEMAHYAMTKTAQLTLSRSLAQLTQGTNVTVNSVLPGSTATPGVQKFVGDLFPDEEYESAEKRFMAENRPTSLIQRLIDPDEIASLVAFVSSPLASAINGAALRSDGGIVPTIA

SEQ ID NO: 23471 - protein, 158 aa, Pirellula sp.
MAIDAISFRSAIRSGPDCRKGTFFARSIGLLESPARDFWFVPSMKLIIAIVQPSKLDAIKEALTRVEVHRLTVVDCQGFGRQRGQTGSMRGRDYGVSLLRKVQLQIGVNEEFVQPTIDAILEGGRSGESGEIGDGKIFVLPMDDCVRIRTGERGGEAI

SEQ ID NO: 23472 - protein, 324 aa, Pirellula sp.
MATDFRLKEQLPELTEQIVSTYTSDDSINHLGHCPLPSYTAVVDILLDLKDILYPGYKRHTNLHAGNIRYHVGGLIDSLHDQLTTQIARALRHEHRVLQNHKDCETDIDFEAKGQAMAIELLKRVVKLRHMLATDVQAAHDGDPACQTTDEVVFCYPGFEAITVYRIAHELVQLNVPFIPRMMTEWAHKETGIDIHPGATIGEYFFIDHGTGVVIGETCHIGKHVKLYQGVTLGALSFPTDADGQLIRGQKRHPTIEDEVVVYANATILGGRTVIGRESVIGSSVWITRSVSPGTTVVLEKPQLKVRGSDEPADELRPEVNYQI

SEQ ID NO: 23473 - protein, 771 aa, Pirellula sp.
MSMPASGTLRVTLLSLHGLIRARDCELGRDADTGGQVKYVLELAEELSRREEVESVELVTRQIFDERVGPDYAQVEEIINPKAKIVRVPFGPKRYLRKEGLWPYLETFIDQMLGHYRRVGLPDLIHGHYADAGYAGAQLARLLHVPYVFTGHSLGRVKRQRLIAASQESKAPKPPRELDKKFKFTVREEAEEFALETASMVITSTGQEVEEQYAVYDHYQPDRMEVIPPGVDLDQFYPVDESEPLPRIHDLLTPFLKDSEKPMVVAMARPDERKNIEMLVRVFGENPKFREMANLVLVLGSRDDLREMPSGQRRVLTNVLHLIDVYDLYGHVAYPKAHRPSDVPELYRLTARRKGIFVNPALTEPFGLTLLEAAASGVPIVATNDGGPRDIIANCQNGLLIDPLSAEDIDHALMRCLTEPEQWQTWSENGIEGSRTHYSWANHVDRYLRDVTEIIEQSATPALAQSMGRTTRRLPEFDRIIMTDLDNTLTGDDEALADFVDLLNTAGRDVGFGIDTGRSLDEAMSLITKLNLPRPDVLSAAVGTELYYGEGLTPDLSWRKQIKHHWQPKLVHEVLDSIPGLFLQTEKDQTEFKISYRIDPEDSPSVAQIRKMLRSAGLRVKVVLSLGSFLDIIPLRGGSELSLRHLAYRWGFEPERLLVAGDCGNDEGMLKGGTLGVVVGNYSPELEKLRRLPRIYFAEGNHARGIMEGIEYYDFLNHIRIPNDKIEHEPGKHRTSEKAGEESNEHQDDEPAGDTNDDRNQRQSSEAAAAS

SEQ ID NO: 23474 - protein, 942 aa, Pirellula sp.
MNSTIASNPTSSRIVSITSLPPKVLATDLDGTFLPLDGDDAAVASMKQIREQLEAIDVPLVFVTGRHFDSVRDAIGEFNLPKPQWILCDVGVSIYKADGEGGYIRESAYEQILDEVLGDIDIQKHRLAIGELENFTLQESYKQGRHKWSYYVPADQLEACHQAVEAYLKLHELPCSIVSSIDPFNNDGLVDVLPHGASKAFALHWWCDQHELQPEQIVFCGDSGNDTAALIAGYRSVVVGNADRKIARKVADAHQAAGWVDRLKLARGTSTSGVLEGARWFGLFENSIEETSIEATSPLNATDLPESIPWGARLIGANRAEFTLWAPKQKQVVLELMPDRLVRMQREDRGFHRCIVDGVVDGTRYQYRFVRDEHVAAFADPNTELSVDMLLHALPDPASRYQPEGVHGPSSIVDAQFPFQATADSAADELDELIIYEMHLGTFTEQGTYLSAIERLDELVDLGITAIELMPIAACAGHWNWGYDGTHWFAPMTAFGSPNEFRQFVDAAHIRGLLVMVDVVYNHFGSEGNYWTEFGPYTSRKHNTVWGAAPNFDDPKRGDLVRRFVIDNAIMWLKEYNLDGFRVDAIHCMKDDSAKHITTQMSEEIRRWSDKAGRRVWLIAETNVYDAAMVKPLSEGGTGFDAQWSDDFVHSMFATVRPGEQLTQRIYSPGSDLEQTLRRGFVFAGDVRGDRGREAEPTLDTDGMLKRIDTRSSIVCIQNHDFIGNHPTGMRLHQLTSPETQAAAVTLAMLLPSIPMLFMGEEFASPNPFRFFVDFGDPRLQRAVVRGRKREYPQHDWSDGVLPTDEEAMRSSVIGSVELGSETMRNWYKTLISIRKQFVGSGLLSPQNFSVDVNCEANLYSLSYQTPNEALQVMVRLSPLTEDDSVDEPSAIDPLPSRPEGASPDSWRLLADSMEAFGERLTEGLLPNHARICYFEHDEPTA

SEQ ID NO: 23475 - protein, 489 aa, Pirellula sp.
MFWQVRSPMIRPLTPWTIIPVTSPQPISSETEPTVPAESISADSVPDFRSTNRPVSRVAVLGATGSIGVAALDVIENLNRCDPDFAWEVSSMSGHSQIDPLIELAGGCHTPPKCVVVSDAEMEAQAAKALRTASTQTSSRLTERCRLDVGPDALVRAATENDVDVVVAAIVGRAGLESTLAAVHAGKRVALANKETLVVAGPVVTRAAANNGAQLLPVDSEHSAIFQCLAESRARQSQYATAKQSIQPESVRATDPPSSTTDSPAKTHWPGVRRLILTASGGPFRDWTTAQMREATIEQALAHPTWKMGAKITIDSASMMNKALEVIEAKWLFDVPADKIEVVVHPQSLIHSLVEFEDGSLIAQVSPPDMRIPIQYALTYPRRLPCPAPELDRSQAWDMSLCPADPDRFPALALGFEVARVGGTAGAVVNAANETAVDLFLHGQIRFTDIPEICRRTLLDHDHESSPTLERLLKLDVWARARARELAQI

SEQ ID NO: 23476 - protein, 445 aa, Pirellula sp.
MNRLRQWRDNFFRPGEIRLLAWSTAWFFCLLGGYYQLRPLRETEAFTRGSDEIPWLFLASFLTMLVASPIYASVANRGRGMRLVSRVYRFFELNLLVFFFAMQVSDPDIAAWVGRVYFVWLSVFNLFVVSLMWSVFTDAYRSDQAKRLFGFISAGGTIGGIAGSAFASWLSQQVDISYVLIAGIIALELCQQCGRVFAKTLSSQNGANEAAEKPSDETAALASTEQTATSKEKHSMWIGIRTVWKSPYLLGLCLFMLALQACATTVYCEQADFIREANLNEADRFALISKINLWVLSLTLAVQLLGTAALLRRLGMAIVLGVFPLIYVVGFAGLAFWPSLHWIVALVVVHRASSYAVFAPAIQILYTVVDRRTLYQAKGFLDTAVVRGGDVLSAQLFGVLRFNGLSLTAIAAGFLPLAVLAGLLGMRIGRQQSEMQQRGRPAGHD

SEQ ID NO: 23477 - protein, 448 aa, Pirellula sp.
MSQAETTKLPYKVKDISLADYGRKEIELAENEMPGLMALRSKYGAEKPLKGARIAGCLHMTIQTAVLIETLVELGAEVTWSSCNIFSTQDHAAAAIAAAGIPVYAWKGMTEEEFDWCIEQTLDFPSGEKLNMILDDGGDLTAMVHDRFPELLDNIYGISEETTAGVHRLEVLNKSGKLRVPSINVNDSATKSKFDNLYGCRESLADGVKRATDVMLAGKVAVVCGYGDVGKGCAHSLKSYGCRVLVTEIDPINALQAAMEGFEVTTMEEACKEGRLYVTTTGNKDIILGEHMKQMPNDAILCNIGHFDTEIDIAWAEQQVADGKATVSEIKPSDIGAVDRFTFNDTGRSIIILAKGRLVNLGCATGHPSFVMSSSFTNQVLAQMELYQNRDNDKYGVQVYLLPKELDEEVARLHLEAIGVKLTKLTQEQADYIGVPVEGPYKPNHYRY

SEQ ID NO: 23478 - protein, 247 aa, Pirellula sp.
MPNSKYFVVGAGGGIGTELCKQLVATGHQVMLVGRNEAKLQTLANELQQPFQVCDGTDWDGLAGVADYTLEHFGGLDGAVNLAGSILLKPAHLTSKDELQSVIEANLITAFGLVRTMAPRLKKQGGGSIVLMSSGGAAIGLTSHEAIAAAKAGVAAMARAAAATYAASNVRINTVAPGLVETELTARIWQNERSADASRAMHPMGRLGKPEDIASMIAWLLAPENSWITGQDIAVDGGLSSIKSATR

SEQ ID NO: 23479 - protein, 567 aa, Pirellula sp.
MQLMDQDLSQLIARGTKDGFLTYDEVNAYLPDEDVNPEKLNSLLLALENRGIQLIEASEKKARDAAARRPSPNVRGLRSVDMTADEESPEQILANEAASQSFSSADMPKASEDPIRMYLSQMAEIPLLSREEEIALAKKIEITRKQYRRSLLETDYALRATVDTLQKVHSGELPFDRTIKVSLTERLTKEQISQRMPHNLRTLNDLIAKNKADFEILVRRSASPRLKAEVRKQFLRRRRKCLELVEELSLRSRRVTPLLHQLEKISGRMTFIRERLADLGNDAMSRDEAADLRQELRELMLVTQESPTSLHNRMAKVRRHFDQYEATKRELSAGNLRLVVSIAKKYRNRGLSFLDLIQEGNTGLMRAVDKYEYRRGFKFSTYATWWIRQAITRAIADQARTIRIPVHMIDVLSKLRQAQKRLTQTLRREPTYEDIAEATDVPIEEVRRVMDIGRHPVSLDRPVGEGEDSSFGEFVQDSETDNPVRIAASGMLRNKIDELLKTLTFREREIIRLRYGLVDGYSYTLEECGRIFKVTRERVRQIEAKAVAKMQSPSRAERLSSYLKPAA

SEQ ID NO: 23480 - protein, 286 aa, Pirellula sp.
MNSPDAFPGDSSPESAAAAFHPNGFRLDGRRVVVTGGTQGVGGAIARGLTSVGADVVLIGLERDPATEATLVSCRENGRTAELILCDLSKPAETWIDDLLAQIDRVMPGVDTLVNNAGTFIDVPFLEMTPDRYQTTMNLNVGAGYFLTQAFAKRWVQNQVAGRVLFTGSINGFLAEPDHTAYDTSKGAVASMVRSLCVSLAPHGIRVNSMAPGLVRTRLTDVVNHDASIESWMQLHTPNGLIPSPDACVGAAIFLLSDVAQHVHGQTLLVDGGMSTWQQPDLPAER

SEQ ID NO: 23481 - protein, 568 aa, Pirellula sp.
MRQRFAMIYALPQQANGTAGAWSHSPNRVDVVSGVEETLMGKKLSRRSLQDDAFDAEDSVNRRSRTMGQEFSDSISEEIESGAAGDEDVVSRRDEFPTDPTEDPVRMYLMQMGQIPLLTRDQEVAAAQQIEATRERYRHCMMATDFMLQAALKLLQQVRDKQLRLDRTIEVSVTNAAEKKAIMKRIVPNTRTLDYLLRQNRGDYMVAINSSLPMRRRRAAWRNLVIRRNKAVRLVEEMNLRTNKLQPIFEKLRRSCERMQEIKAILADAHRSTMPGMPSGDELRSELRSLMRLTYETPRTLSRRVDRCDTYRDDYDAAKRVLSAGNLRLVVSIAKKYRNRGLSFLDLIQEGNTGLMRAVDKFEHARGYKFSTYATWWIRQAITRAIADQSRTIRVPVHMIDTMNKIRQITRDLVQEHGREPTAEEVSKRSGLSLDDTRVILKMSRQPLSLDQPVGDHDDSVFGEFLQDHRDDDPLVETNREALKHQIDLAMETLNYREREILRLRYGLADGYTYTLEEVGRIFQVTRERVRQIESKAVRKLQQPYRAKSLVSFLDGAEVSLFEGSEAI

SEQ ID NO: 23482 - protein, 273 aa, Pirellula sp.
MASVSFHVLSLVTNMTRWPGVKLFDLSGRTALITGGSKGLGEAMAAGLASAGANVCLVSRNEQEASAAAEKIAGEYPVRSIGIGADVTVEADVANMVQACVDQLSGLDVLINSAGINVRGSIDELSLEQFRQVQSTNVDGMWLCCKHASSVMKKNGSGRIINLASTLGLVGLANRTPYASSKGAVVQMTRALGLELAPHNVTVNAICPGPFLTPMNVPIADSEEAKRFIVGATALERWGQMQEIQGAAIFLASDASSYMTGSMLTVDGGWTAR

SEQ ID NO: 23483 - protein, 187 aa, Pirellula sp.
MEPKTRRILLAIGGGIAAYKAADLCSKLAQAGHQVQVVTSRAATEFIGDATLAALSGRPVVHEVFDARFPLGSHIELTREIDAMVVAPATANLLAQFAQGMASDLISTLYLQNTSPVLLAPAMSDPMWNHVAVQRNVQTLQEDGCHLVGPEDGWLSCRVKGTGRMSEPVTILKTLEALFTDRAAQID

SEQ ID NO: 23484 - protein, 282 aa, Pirellula sp.
MSAESSDSISPSDSSRPLKGKRALISGASRGIGRGIALEMAQAGASVTINYHSNPEEAESVVKECEALGVAAFAIGADISDADQVRGMVSDACQQMGGLDIVVSNAAYSDRHLMLESDMDEFRRTIDVSMWGAFHLVRSGAQKMVDSGNGGNIVVISSPHAHMPMPGAMAYNMAKAANDQMARTAAVELASKRIRVNLIHPGWIDTPGERKFFKEETLRSEGAKLPWGRLGQIREIGRGAVFLCDPRSEYITGSTLTIDGGIQLPWREMYRVEEARRETAAT

SEQ ID NO: 23485 - protein, 865 aa, Pirellula sp.
MLVRGVTSILGECHQIDWWLCVHLVGRNSGERNWSIKHRMVRRCDPERYRQSQESLQNSQPNPISIPVSTVNELHSNSLGMAHSFNPSIAIADTNERYVSANAVYAQQFHRSPSELLGGTIREMVGDDNYQSMKPHLDRAFSGEQSTQSVAEATTDGVTTYRQVSYDPQLSADGQVTGVMIVAMDITDSKRRESDLRESNEFSRAILESSPDCVKVLNEEGDLMSMNAKGMCLMEIDDLEPFRNQAWWSYWPEQAQGTVRKSLKDARENGEGRFEAECPTVKGTPKWWDVIVTPVRRNSGEVKQFVAVSRDVTTRRLHKQELEEREKRLHRVIDNMNSFVGIVDLDGVLQEVNQTAIDAASVAREDVIGRPFCEAFWWSHDDQVAEQVKSSVQAAIRGETSRFDIAYRIAGDSSRMVDVSFVPVRDESGRDESGPPLYVVASGFDVTDRYEFERSLKDATDAAEQANRAKSQFLANMSHEIRTPMTSILGYADLISQKQIDEDTRSHVATIRRNGAFLLGLINDILDLSKIEADHMEVFDESVNLIHLIEDVLSIMQVRAAEKDLEIRVDYCGKIPREIQADSKRLRQILVNLVGNAVKFTEAGHVRVAVRAEQSDRRTRVHFDVVDTGIGISDERMKKLFQPFSQGDPSIMRTYGGTGLGLVISQRLVAMLGGEITARSRVNEGSCFSFCIDAGQVDCTSPTTALDQESIRSIVPQPPQSESALSESDDGLLPPSLDCQVLVADDRRDIRYLLKRILAGAGASVDEVEDGQQAVDHIAQTLSSESCPQVVILDMQMPNLDGFEATQELRTLGYTGLIIALTADAMDGDRQRCLDCGCDDYMSKPIDSAKLIGKIAGLLKPTGVE

SEQ ID NO: 23486 - protein, 245 aa, Pirellula sp.
MNNNNRVAIVTGGSRGIGAAIAERLASDGFSVVINYANSSKAADELTQRITEAGGSAQSFQADVSDSDAVEKLFDFATESFGGVDVLVNNAGVLKMQPLAETSDEDFARLVDVNLKGCFHTMREAACRLRDGGRVINLSSSVIGLRMPNYGVYSATKAAVEAMSSVLANELRGRQITVNSVAPGPTATKLFLDDKSDELIDRLTNMSPLERLGQPDDIASVVSFLAGPDGSWVNGQTLRANGGVV

SEQ ID NO: 23487 - protein, 398 aa, Pirellula sp.
MVPNWRHPSRMIASTILRAPNARTAQPNLSFDLAKELAEKHGTPLLVVSRSKAIETYWAMKNALPGVDLYYAAKANPDLHFLSTLNGENAFIDVCSPGELKAALAAGFTPDRMLHTHPCKTDANLWECYEAGVNWFVFDNPIEAEKIRRLTPDVNLLLRLATTGASSRINLSAKFGCPMHEALELLATAKAKGLKVRGFSFHVGSQCLNPQDYVEVLRSVREVWDEATKAGHHLEVLDIGGGFPAPYREDAPSIEAFGEVITNGLREIFGDLPIRLIAEPGRGLCTESVTLITRVIGKSRRWELPWFFLDDGIYGSFSGKIFDHTDFPLLVENDGSRETVPCVVAGPTCDSTDIVSRDQWLPDLEVGELVLVPSMGAYAAASASPFNGLPMANSVAID

SEQ ID NO: 23488 - protein, 269 aa, Pirellula sp.
MNTLFELNDDVAVVIGGTGELGGHMAQALGSAGARTAVLGRNAERGEEKVKAITSGGGEAKFFAVDGMQADSLAEARDAITAWAGTPTILVNAAGGNHPDATIPPGGDVCGLPREAWQHVFDLNLVGGALLPSQVFAPAMIEAGVGSIINIASMSGIIPLSRVVAYSAAKAAVINLTLWLAREWATTGVRVNAISPGFFPAEQNRKLLYNDDGSYTERGGQIIGHTPMARFGKPEELAGAAIWLASRKASSFVTGQNIAVDGGFASVTI

SEQ ID NO: 23489 - protein, 801 aa, Pirellula sp.
MARLGDAAHFEALFHARMEARVNSTATTENQRSLTRSLVNPLAVAVVMIVLIISGVIAFHNIRELQETRLKVGLTLKVLASLAEIEGAVMDAERGQRDYLITDDQRHLEPFKEAVKRTRESLDQFEKLTQDHAVQRAKFNYLRENVEERIKHLNAVLDIRAEEGPEAARAAVIQNLDQNLMGKIDDLAISMRKIEEDLLVVREAMATRAYRSGIVTSVSSTLIGLILVGSVLYLLERNRRKAERDALMLNATRERVQLALDAAEMGAWNIDPETNTLQTDERYRRIHGVEQEEMTFEDSLKRIHPDDRARVRQAVRASMSPLDPSPYSVEYRVVHRDGSIRWVSSKGIARASRRRGKAVLTSFDGTVADVTERKRQEERLQRSEQIALAANQSKSEFLANMSHEIRTPMAAILGYADVLLGHLEDPDNRNCVMIIKRNGEHLLSLINDILDLSRIEAGKLSVDAESVPLPRLVGDIQSLMQVRADEKNVDFQVEFEGRVPQSIETDPTRLRQVLINLIGNAIKFTDEGSVRLKVRFMKGADPPVVEFSIVDTGIGISKEQQDRLFKPFSQGDASVTRKYGGSGLGLAISQRLIEMMDGEMSLESELGEGSTFFVRLPVHSVEGIELVTPDLVKQPSRPEELLAEIPKLDCRVLVVDDRRDVRHISQHFLEKAGAKVDTAEDGQQGVDAAIQARDSGHPYDLIVMDMQMPVVDGLQATALLRSAGIDWPIIALTADAMKGDRDRCLNGGCDDYLSKPIDHIQLVSMVANYTHEMDVSELVQRRHLRADQLQEKIEREDRSRS

SEQ ID NO: 23490 - protein, 427 aa, Pirellula sp.
MHYQPLPFDRDLIDRIIEDHPTPFVLYHEDGIRARARELTDAFAWNEGFQQYFAVKATPNPHIVAMMAEEGGGADCSSVAELITCERLGITGQDVMFTSNNTTMEEFEIANKLGAIINLDTPHHIDQIAQLSPLPEMVSFRFNPGPERQGNVIIGDPKEAKFGSTREQLMDGYRRCAELGISRFGLHAMVVSNELNIEALLQTAEMLFELAAEIHRETGISVECINLGGGIGVPYQPGQEPVDLPAFGDGVRKLYESILVPAGIAPVRILMENGRAMTGPFGYLITKVINQKSSYKDYVGVDACMSNLMRPGMYGAYHHITVMGKEDQPADRTVDIVGSLCENNDKFAIDRKMPATEVGDIAVIHDAGAHGHSMGFQYNGRLRSAEIVFNDAGEFRAIRRAETFDDYFCTVDFDSVKVDRKQSATVG

SEQ ID NO: 23491 - protein, 285 aa, Pirellula sp.
MKSIQRVIRGVPQHWVGDGFPVRSLFSYAGGNEFDPFLLLDYAGPHNFAPDEAKRGVGEHPHRGFETVTILYQGELEHRDSSGSQGTIGPGDVQWMTAASGVVHEEFHSRRFAKEGGTLEMVQLWVNLRSTDKAAPPKYQDLRDEQFPRFSLPNDAGIVRVIAGQLGDAEGPASTFSPINLWDIQLTGNATATLTVPAGHTCVVIVQKGSVQVNESLIHAVELALLERSGDEVVLEAESESRVLLMTGEPLGEPVVGQGPFVMNTRDEIRVAIADYQAGKMGRLD

SEQ ID NO: 23492 - protein, 935 aa, Pirellula sp.
MIRPATKTLLVVLALSFEWSVGLDSLIGRTNQAIADTLPIDELPDDREVLFSRDVAPVLKKNCVACHNSSDDEGGVNLESGEQIRTSELDDLVLPGKPESSRLFLLASHADDPVMPPEDNDVSASILTPMELALLKRWIQSGAVVDQAPSTPIKREWQPLPSSLQTVYGSSMTDDGRLSAISFGNEIRLFGAKSAQPIETLAIVEGEVTKPAHDDFVQDLHIDSTGRQIISAGYRNVKLWEMSPFESATIPAINLDDTLAIAMNASGSHFAVLSRRGELSVAEVGKDRWLWMKSFDLPDHLKTEGLKTDNPTKIRIALDNAAQQAAIQWDSAIRIVRIDRKDVETFDAANTLTSMQWIEEDHLATATDKGQVLFWKRDEEVWTKTEHNVFEQAVLAIHSASESPGRLIAMDAAGNLANWNPTDQSFEATGQLPSPAVSASLSSNGATLWISTESGALGRYNIADQSYLEIAKKDPVAAAQLANDNWQTLVTETLVAAQEKDAKQAEDDVMAEQKNLESIAKDIETKTKLRDEKQARVEEAKQAAESAAKKLAEAEQALATKESELDAAVTALGQAEKIKVSGETRLKELEAERERHQQILAKLKQDHESRKATATASQSRHDSSRATDATFAVMLSGSRILTHAANTDDASEDSWSLWAESGDWLAELPELPTDGQLIASGDRCVLIQGTNGQTQAFVARPRLWSLRQTIGATTGPSPFADRVLSIDVHPSGKLLATGGGEPSRTGEWMLWKVSDGSLIRKIPNPHGDTVFCVRFSPDGQTLATGGADQMIKLWDVESGKLIKTLEGHTHHVTSIAWNANLRELATGSADATVKVWNIETGQATRTITGFKTEVTKLVFVGRENRLGVTSGDSVFRVYRTDNGARETNTKVAGDYLYALDSDRDGSQFIVGGASGTATLIDKSGKQSLEYSLGEE

SEQ ID NO: 23493 - protein, 105 aa, Pirellula sp.
MPDAIMKQVVTVVSPHLAENVLAALRRAPLEGLSVMEVKGYGRQKSYLDQYQDTEYSEAFVPKVEITLWVDDLRLEEVLDKIVAVTRTGRIGDGKILVMPVASFI

SEQ ID NO: 23494 - protein, 1246 aa, Pirellula sp.
MIFIPSPAFGLSMLQATSTDQLLAELIRERILMLDGAMGTMIQRLELDEAAVRSDRFADHHKDLKNFSDILCLTHPEKITEIHSKYYEAGSDIVETNSFGASPIGMVEFDLPLELVNEINVAAVACARKAADQWTEKTPDKPRFVAGSIGPTTMQLAISTDVEDAAFRATTFDKLADSYYAQVKSLCEAGVDILLPETAIDTLNLKSCLFAIQRYFDEGGRRVPVMVSGTFDKGGRTFVSGQSVEAFVTALSHFPVLSVGMNCALGPDIMRPHVEEMSKATGLPISCHPNAGLPNEMGAFDLDPKPMAEIVGEYADNGWINILGGCCGTTPDHIRVMTERVQGCKPKQEDKSGPVWTRLSGQLPMVMRPEIPFTMVGERTNVTGSRKFARLIRNEEYDEAVEVAREQVENGATIIDVNFDDALLDGVEAMTRFLRLIAGDSVVAAVPVMIDSSRWEVIEAGLQNVQGKAIVNSISLKDGEEEFLRRARLVRQYGAATVVMAFDEEGQAADEDNKVRICKRAYDLLVNEVHFPPEDIIFDPNILTVATGMEEHNNYAVDFVNAVERIKKECPGAKTSGGVSNISFSFRGNDPVREAIHSAFLYRAVKAGLDMGIVNAGQLEVYEEIPKDLLEHVEDVLWNRRDDATDRMLEFAETVKGSGKKKSGEDLTWRENSIEERMKHALIKGIDKYIVEDTEEARQHYDKCLHIIEGPLMAGMSVVGDLFGQGKMFLPQVVKSARVMKKAVAYLEPFMEQEKIESGTQDHKARGKFLIATVKGDVHDIGKNIVGVVLQCNNYEVIDLGVMVSSEKILEEAVKQDADMIGLSGLITPSLDEMVHVAREMKRIGMKKPLLVGGATTSAKHTAVRIAPAYDGPVLHVLDASRSVGVVEKLLSDESRDAFLEANVSEQEKLVSSFRERKQTLVSYEQALEKRFQTDWETVRIDQPEFIGTKVLEDFPLATLREYIDWSPYFMTWELKGKYPKIFQDETVGPIAKEVFEKANKMLDRVIDEKLIRAKGVYGFWPAASDGDDIIVYTDESRTEERTRFHCLRQQWERRGQKDFRSLADYIAPVDSGRKDYLGGFAVTAGLGAEELSMRFKKELDDESSIIASAVADRCAEAFAEYLHQQVRQQWQYGKEENLSNEDMIAEKYRGIRPAAGYPACPDHTEKRTLFDLLEAEKNTGINLTESYAMSPGASVSGLYFSHPDAKYFTVDRMTKDQIESYAARKGWPISEVERWLSPNLAYDPS

SEQ ID NO: 23495 - protein, 484 aa, Pirellula sp.
MLDFGTAGTQTLGRREIIGTAVEQRASDEQRSNIGQSKLNQRVFLWSLTSSLAGFLFGFDTVVISGAEKAIQGLWALGDFQHGLALSAALWGTVIGSLVGGWPTDKFGRKKTLLWIGILYLVSAIWSGFATDVFSFMIARFIGGLGVGISTVAAPLYISEISPPKHRGTLTGLFQFNIVFGIMVAFASNYLIGTWGNENAWRWMLAVEAIPALIFTVMCISLPSSPRWLIAVKKDQAAGMSVLKQLRPDASDEEVQRTVDEIVASLRAESDLTPAEPFWSRRLFTPISIAFLVAFFNQLSGINAVLYFSPRIFELAGMGEQAALLQSIGIGITNLIFTFVGLYLIDRLGRRTLLLIGSAGYILSLGTCAYAFQSETFSIVPACIFAFIASHAMGQGAVIWVLISEVFPNEHRAAGQSLGSFTHWIFAALLTLVFPAVVETFHPAAIFGFFCFMMVLQGLWVITMLPETKGISLEQMEAKLGIRV

SEQ ID NO: 23496 - protein, 860 aa, Pirellula sp.
MWQAWYEYRIDYALFTIVFLVGHSSILSRVRRAMPPPSTTHPETSTSPEAIGSGLRTRLSFCILVLLLIGGFIAVETADRVQRSRMRQQVFGIAPTYAAELQQLGHANIDEQTSPDDPQYLRMIEAQKRWLSVNPQVTDIYTMRRVTELDLSTRPLPDRENNNGHLYKIIVDSETDYSGDGRIEGVRESRTEIGEIFSDSSVEQIEQAFRGVTTFANQPSRDRWGKWVSAYAPLFDADGKVEALVGVDFPAENYIHSIILTRLGAMGIIAALITLFLGAVTSIGMLKAGIVAQQRSHALLQDQRDLATQAAAQARQAAIIKNQFLANMSHEIRTPMHGILGTAELMTRSSLDEQQRHYMYMIQTSAKGLLTVLNDILDFSKVDSGQMTLESVPFELKDLLSQTMHAVVNLKNEEVDLQFQPPVGVPEIIVGDPTRLRQVLINLVGNALKFTEQGRVTVTVENETRDATTLDTSDSKGSRIAFTITDTGIGMTQQQQAKIFEAFTQGDSSTTRRFGGTGLGLSISSQLVELMGGRLQVSSVPNEGSSFRFDIPLRTTNGVEPHEIAKTQPLETSTKSFGQCDQPRELLLVEDGAINRTVAETMLRSRGHRVTSVSNAKDAIEQLRLHSFDLVLMDVQMPEIDGLTATQIIRNDLPAPASEVPIVALTAHAMREDRQRCLDAGMNDCLTKPYPPEVLFETIESFATHTDNQDDLVSSPQSIEKSPSTNVDEPSAEPLNREVILHNVGGDLQVLAMLVQTITDELPPQMQRLQQAIEVGDSTQIARAAHTLKGTASAIGATRAQEIADRLETFSSGETSQEKSSHFFNNQMKALASAFDLAQTELKKFLRSSSGRENPGNETL

SEQ ID NO: 23497 - protein, 519 aa, Pirellula sp.
MFDPMMDDFDDVSAQSTDVVTGGFRKLPVDDSEDDNAVSVADAPEGEVQLDSPDELIALDESETWSDDPVRMYLTQMGEIPLLTRRQEIELAKRIEETRRRFRTKLLENHYVLVEAYKTLKKVYRGQLPFDRTVQVSVTDRLEKEQIIGRLPHNLKTLQTLLNRNRHDWKVAMSKSAPARRRAEAWRALARRRRRAVRLVEELGLRTQRIETRIGLLEKFSRRLDEIDELVRQQKRTKHGREVREQLLHERRQILTACQETPTSLRNRVKMLGSVYSDYQQAKRELSEGNLRLVVSIAKKYRNRGLSFLDLIQEGNAGLMRAVDKFEYRRGFKFCTYATWWIRQAITRAVADQSRTIRIPVHMVETMSRVRNVARQLLQELGREPSIEETARRADVTIEEARRVLTMSRFPISLDRPVGNSEDSQFGDLLPDGTAESPQIGATQEMLRQRITGVLKSLSYREREIIKLRYGLGDGYSYTLEEVGHIFKVTRERIRQIEAKAVRKLQQPSRSQDLVGFLD

SEQ ID NO: 23498 - protein, 226 aa, Pirellula sp.
MKSGANMHLRGVALDMDGLLFDTERIYFQVGQVLMERRGHTFTLELQQKMMGRVGLSAVGQMIDHHQLDDDPVSLLAESDDVYGDLLLGELRPMPGLAEWIERLRTSGLPFGLATSSRRKFVDMILPTTEWSDDLAFALTGDDVTHGKPNPEMYLKAADRLRVSPTEMLVLEDSGNGSKAAVSAGAVTVAVPNEHTRSHVFEDVHLVAESLADPRLWELLPQNTNA

SEQ ID NO: 23499 - protein, 206 aa, Pirellula sp.
MFREFRGRGKKMGLTGVSGWFTLRSQLSTTFGLVGLFWKRFPVKRARMREASCLVGDGLQGIRLVTNIYVGNLSFKATEEELRGAFEQYGEVSAVNIIMDRETGRSRGFAFVEMADAEGAKDAIENLNGHEIDGRSVTVNEARPREPRSGGGGGGGGYGGGGGGRGRGGGGGGYGGGGGNRGGGYGGGGGGYGGGGGGGYGGRGDR

SEQ ID NO: 23500 - protein, 871 aa, Pirellula sp.
MPALLIRCGSTTRGIRSRWSNVAVPSEPMSSVSEFQTSSTYRALANALPLNLLIKAADGRRVFANDSYLKWRGVTWQELAGKHDEDLFPPEIARKYREDDQKVMQTGESLHSVESAKLADDSIGWIERVKTAVHDHHGNLLGVQVLFWDVTAKVEEEKATQFEQSLLKTLLANIPDSIYFKDIDSRFIRVSHAMAMKFGRASVDEVHGRTDADIFTPEHAEGARLDELRVIETGEALVDRVERETWPDREDTWCMTTKMPLRNDTGEIIGTFGISRDITDLKRSEAALHEAVRMADAANRSKSEFLANMSHEIRTPMNALIGMADLLSQTKLDPDQQDYVQIIQESSNGLLRLINDILDFSKIEARRLELESVPFSLGKTIESTLRSFSFKASEKGLELQRDISPELPDRLIGDPGRVRQVLTNLIGNAIKFTDHGGVRVRVEVLRREERADRDLAATHSGRESPERDDMVELRLSVCDSGIGIPPAQQDAVLNPFTQADASTTRRFGGTGLGLSISRQLVELMGGELHLQSEVGVGTTFSFQLKMPVCPASMPNEVDDEEEDLGGPARQRLAPLHVLVAEDGVTNQHVIAGLLRSLGHKCSIASDGRETLTKWRSESYDVVLMDMHMPVMDGLEATRAIRQEEWGTERHTPIVALTAAAMSEDAAACREAGMDSYLTKPIHSRKLRDALAPYQRELPPADDGSHEETLEQAFSPAAHLATEQDSTTINAAHAAFPSLGSTSDAISLSPENIGCLDLDSARSRIPGGTAGVLRLAFVFRTECAQLVDQLSNEIPAGLNDETRRNAHTLKGACGLLGAKQLQEAAERIEEAGRENRVQDSPELLADLQHEAQRVLRAIDELLSQSDNADQPK

SEQ ID NO: 23501 - protein, 1739 aa, Pirellula sp.
MSDPQPESKPLVVGVGAGAGGIEALQELLASLGDSPDMAMVFVGHDASELHATRIEQLADATSLRVVELKSRKLIRPNTVYICPPNSLLSISSGSRLMLKPATEESPATPIDHFFHAIAETQGEQGIGVILSGMGTDGTLGLKSISDAGGMTFSQISSSAKFDSMPRNAATTGVADHVLTPKEIANELNDYVVYRKQQSNRLTRESMLEEIERSIPEIADVLYKATKHNFKHYKTATLTRRILRRMQILQISDVATYLGRLRDDQDETQNLFRELLIGITAFFRDPESFKALAEEVIPQLFEGRTASDPVRIWVPGCATGEEAYSLAILCYEHLDRLKTQRDDDHAKDSLPTFQIIASDIDEHALAIARQGVYPLGITESIPETRLKQFFVKRGKRYHAKRNLRESILFSLHNLISDAPFSRQDLISCRNLLVYLGPHLQKKLIPLFHYALRPNGHLFLGPSESISSHDELFRTVDAEHRINQRKGTETVTDTADSRGFVSATEATQTAAIVPNEEDTKEIHQVLQRIILDEFAPKAVVVDVDGKVICTLSDTSPYLSSGEGMHQNNLIKMAHVHLRIGLRGAFAEAKANRRRVVRDDLLIMSESGQQRVKLTIQPMMQLGHETELFMVAFEDLGPSIAPSDSSTDDSIGSDPSIAADPHAQQRIEQLERELATTRDDLDRSIQEMEATNEELTSSYNELLVMNQGLQTANEKLEISKEEIRSSSEAVARANADLQNLLRSTRIATIFLDDDLSIRSFTPAATEIYGLIATDVGRPLTQIAPNVQDMPPLPKWELLIQEDGVEHTIVANTGKAFIRRVLPYRSYSGDHDGIVLTFTDVTQLRESEELFQSLVRASAQIVWIANADGVVESDSPSWREYTGQTLEQWVGLGWLDVIHPDDRELTQKVWTDAVAKDRPLVLEYRLRNRHGEYRWFQVRTAPQRRPDGTVNRWVGMNIDIHDQKQSRLELADREAHLRRVINNQLGLVGVIDRNGLLLEVDDRSLEYARVNRHEVIGKPFHEAPWWNYDPNVAQQMRDAMERAFKGEPVRYDVSLFAHGDDGVLIDFMIAPVFDDDGNIEYLIPSGVDIRDRKKAELKQQEVAVRLEAIFNTAVDGIITIDRRGTINSVNVAAAKIFGYGVDELTGSNINALIPEPEHSEHDGYLKAYEETGQSHIIGHQRQVTGRRKDGSTFSLDLSVSETSLSGEHRYVGIVRDVSDRVRSEQAKKNASRRMQMALRAGGMAAWEWTPKKSYWTKEMYELFGVTDDRKGSPELCFSLTHPDDVESLKRHWQEAIEGNQDYEYEFRIVRPDGEMRWITGMGEVVRGKSGNVTRMYGVNWDSTQEHVQAETLRESERRANEASASKSAFLANMSHEIRTPMTAILGYAELLQDIIQDTEGLHHLQTIRRNGDYLLDIINDILDLSKIEAGKLDVESERFDPAHLIEDVRSIMEVRAKEAGLELTVEYGQQIPASIQSDAKRLKQVLINLVGNAIKFTPEGNVRLVVRMESEPIRLCIDVIDTGIGITPEQQEQLFLPFSQGDSSVNRTFGGTGLGLTISRRLAEMLGGTIHFQSEVGVGSTFTLSVFPGDLTGVAMVDHSQPVSKLVDDLENSSTTPIKLNCYALVVDDRRDIRFLSRRILTKAGATVDECEDGLQAVDKIIESMKARRLPDVIILDMQMPKLDGYATAKKLRELGYDAPIIALTADAMQGDMNLCLKAGCNDYLSKPIDAAKLVALVSKLT

SEQ ID NO: 23502 - protein, 540 aa, Pirellula sp.
MDWGDWAAVEPEDGVAEVADIVEISRQTSNKRFGRFATRYRSSRSPFFPSVTKMNGYATPWASGRTIANTMRPTPMAASWSAPTQGQLTSEQRSSAARKRLMAANSLSTGPQSNHDNPKRVAGSDDMATAEIDLSQTDNLVDGRESSSSDAGESFDPEDRAAARARIEAVLLIAKSPLNYRRLAALADVEDATSARTLVGELNELYERLGRGIRIEQVAGGQRMMTRSVVAPWLRRLGFLAPAIRLSWPMMETLAVVAYRQDVTRADVEAVRGVACGEILRQLMQLDLVRISGRSEELGRPYLYGTTKRFLKICGLASIKSLPPIDWHASCDDVSQSADGEVENIADELTADELKSRDHSQLESHPRRESSDAETSDTNPSETEHLHPTKESDVSVAAIETLATEFTVSLDADQSGAVAVLDAPASDADAASSNDPSAVIEDEEDDLYENGYELDDEEDDDFDDDDWDDDDEDSDDDDDEDEDDEDEDEDDEDSDDSDDDDDDLDGTDDWEEVDDDEADEDWDDEDEEDDLDEEEEEWED

SEQ ID NO: 23503 - protein, 652 aa, Pirellula sp.
MKRLASSTKRTIRLVAAFRFRQNGAFPSDSSPSGGTGFDRSDRIGVLPWKLMLRFIQSLFSSMSLERKCLLFFGSALVVLMCGAFCMVFLLADRWVSSTTQQQARDAAATEMMLIHAAATYTEHLPENKLEMTRQKIADLRSQLLSQDIEFDILGLDDPQPFENLPAPTAPTEPSELKLLQDLEPQFRARLERLLSGDPIDLSKAVDLADDAAMSRIGPANRPVFKELGPTNGRYVYYEPVFMTYDCVPCHVPSGEIISLSKDEDPAKLAAQLPYRVKRVSMPDDKIVKDMTGIRAIVVSIAMFIVAVTLFVLHAIVRYLVLQPLLHLRDVSDAITHGDTNQRANISTDDEFRELADAFNRMLRHLTETQTQLQSVNRELDARVDQFAQLNLQLYEANRLKTDFLANMSHELRTPLNSIIGFSEVLQGIDSLSEKQRRYASNIQKSGRLLLEMINDILDLAKVEAGKMEVRRSEFQLSRLVGAQCDMIQSLSEDKNISLSVEVPEDLPVAYQDPNKLGQILNNLLSNAIKFTPEGGMITVRVVDLHDDRFRLSVTDTGVGVADEDQPIIFQKFRQSKKVLDGDGLTREFAGTGLGLSIVKELAVLLGGEIDFQSELGRGSTFWVILPYRLSDHEMEENEVPISNLAAVPHSA

SEQ ID NO: 23504 - protein, 539 aa, Pirellula sp.
MGASTRFRRQSGKVPYNSTAASVIIARFPHRITFGCPRPRGNENGMFDDKIGDLGVTFDDVLLQPRYSEVVPSEVDVSSQMTQRIRLQIPLISSPMDTVTESEMAIALAKEGGLGIVHKNLSVRRQTEEVLKVKRSANGIIVNPVTLNPAQKVSAAAELMDRANVSGIPIVEDDRTLAGILTRRDLRFLEDPDMPISQVMTRENLVTAVGNVTLAQAEKILTEKRVEKLLLIDEERKLTGLITIRDIDMMKRYPRACKDPQGRLRVGAAIGVGDYERAESLIGKGVDVLVVDSAHGHSRNVIETVREIKQNKSWDIDVVAGNVATAEGAADLIAAGADAVKVGIGPGSICTTRVISGIGVPQVTAILSAVKVAQEKNIPVIADGGIRFSGDITKAIAAGASTVMIGSLFAGLAESPGKMILYQGRTFKAYRGMGSMGAMVKGSSDRYRQKGTEAGKLVPEGVEGRVPFKGPLSDYAYQLVGGLRAGMGYVGTRTIEELRRDAKFIRVSAATVRENHPHDIAITQEAPNYSPDVHSGDAG

SEQ ID NO: 23505 - protein, 1182 aa, Pirellula sp.
MHSLRGILGHKRTHAIGGNVTPMKNSPKSFEIMRRWWTQLWRRPRSWVILVLFVAIADAMTPPDWAVVVAHLIFLPLAWRVLHRRFITWMTAIQSVAVAAVGLLHVFGPIAQRFAGAAGAEPFAWIEPVRLWTFFALMATGYFHIYLQGRLRTRLKHQRTLQHRVHRRSLQIRRVNRALRNEVTRRQETQHRLDQSETTFQSLIDRMHLQVARKSAEGVFTYANEQFCADIGMTPVDVIGSTDAELFGDSIGAKYRADDLSVMSTGQAVDKVEVHPGPDGRIGFAQVFKAPEYDQNGQCVGVQIIFWDITEKHRNEIALRDSEARKRALFDAAGDAVLLIDDQRAIVEANPSASELLQAGGGRLVGRPLNDLISPVSNQWGGLPLAERHQLRLRRGDGSSFESEVSIHHIPVGDATGQAVIIRDVTLQRAAFEAMREAKAAAEQANRTKTQFMAGISHELRTPLGGIRGLTDLLGQQTLPTAARRYVNLIAQNTELLRDVIEDILDFAAIEAGRVAIDPVPVDLHEVVGDAFGCLAVRVADKPVRLCLSIAPDTPRRVIADPKRIRQIVINLAGNAIKFTNRGEVSLRLGPIGDAPPSHGNDANSPEITTNGSTDDTPMAWFELTVSDTGIGIAPENQSRIFDAFEQADRGTNKQFGGTGLGLAIARGLAQRMGGDITVTSQVDLGSQFQCALALPLDTNQKRAEKKPVVSAPEGATAVVSVGNTTMQDAIAETLLHCRWPIRTPSMLEAECVHLHWILTDQTADAAFRIRARKSSDRVLWVTRAGEPTPRRAKREDAVVIEPLHPDELRRWLAGKPLLQSSRGQRKRRRGTKLETTTKSDSNPSKSQAPGTALLTNSQSANEHVNASPTDAIQGYKLLVVDDSATNRLVIHDQLVASGHRVQTADSGEAAVERLASNTFDCVLMDLQMPNMDGTEATRIIHQHALKAGKTPPPIIALTAHVTDQHRQLCREAGMDGYITKPVDLDLLLTEIERVLGVSQSAETDAMLPPPLSEDKTSPTPPDLNTTNSLPNDSSSSTEAAPDETSVEAEDNQHWDWRSQLSKHCGGDSETMDSVCDAFLMEVPSLLTNLKQGAKQGDANKLRSASHTLKSCLRYFAPKEDVAMAAEVESAIQDSEWVERLKDVTNDPNADDAESPESKAIADLQSKATDWVSRIRESVKQR

SEQ ID NO: 23506 - protein, 417 aa, Pirellula sp.
MRSSTKAPPMLSEKTIRIVKEITPLVAANAETITRRFYERMFEANPEVKAFFNQAHQHSGGQQKALAGAICAYFTHIDNPAVLMPAVELIAQKHVSLGIKPEHYPIVGSNLLAAIGDVMGDAATPEIVEAVSEAYGFLADIFIGREGAIYEEQASMPGGWNGTRTFVVTKKVRESEIVTSFYLKPEDEGPLPPFKPGQYITVHMDHPHTPTSPRNYSLSDCASQPHYRISVKREERLVPDAPDGLISNHLHDGIEEGHRIELGPPCGEFTVDPATIAKPIVLIAGGIGVTPLLSMAKSIVHANPNAELHFIQAARNSKVHAFADELRRLAQAGPNVHTKVIYDSPLPGDVEEGKCDEAGFVTENQIRESTPFTDADFYFCGPKPFMKNVHSCLRELGVDEHRVRYEFFGPKEELVAV

SEQ ID NO: 23507 - protein, 686 aa, Pirellula sp.
MMSTPDTSPSAYNDRPQATTGMPPGIPYIIGNEAAERFSFYGMKAILTVFMVDYLHWMSSAATNQGMSNAEATEHYHTFTAAAYFFPVIGALLSDIFLGKYRTILYLSIVYCIGHGALALMGSPPMSAGMWLFAGLLLISIGSGGIKPCVSAHVGDQFGKSNSHMLTKVYQWFYFSINFGSFISTLLTPWVLEHYGPHWAFGIPGVLMAIATLLFWMGRHKFVHIRPGGYRFLQELLSWEKFSSIPKLMIIFSFVAVFWALFDQTGSSWVLQAKNLNREWLGYTWLESQIQAINPILVLTLIPLFQFLIYPTIDRVFPLTPIRKISLGLFVMIGGFAIVALLQERVDAGSQPSIGWQFLAYAVLTASEVMVSITCLEFAYTQAPKTMKSIVMAVFLFSVSMGNVFTATVNRYIQTPAAASLAADIDLEEDAKEPMDNGSFVGELKLDDPAAPKLTLLGPDNTLGTPDDATLLLNKEGKLDSIENASLTSFNAVAEKIEAYFLDQTGDDSTRAFPSVEEAQPLVAGAEDAFGNPITYKLLSRDQYQLVSAGADGENDTQWDETLTGTVDRANTSDTVNTDAPTFNWLERQKIAIESEGDPNKAETVKSKLISERGGGDETKLSRDYAIGGRTLLEGAAYFWFWTTCIFVTAILFVPVGYLYKEKTYIQDEEDAEHEAEALADEAIST

SEQ ID NO: 23508 - protein, 351 aa, Pirellula sp.
MVQANSRARTSLFLSLWLNLMTHDVYAVGNALVDIQTMVADDLLSELKLDKGIMTLVDDEKQATVLSRFDLPSLSRCAGGSAANTIAAVADFGGKAAFVGKIGDDETGQFFLKDLRALGVTIDVDPQPGTPSGTCAVLITEDAQRTMLTNLAASTALSEADIDEAVIAASKYVYIEGYLFTGEQTKAAAYKAIELAKKNDVKVAFTASDPFLVNMMKDEMWDLIRGPVDLFFCNEEEAKSLTGLEDPIACANKIHESAENVAMTLGPNGSILMHGGEAIPVEGVKVKAIDTTGAGDMYAGGILYGITNGLDWRQSGHLASHAAARVVAQMGARLQKPFTEDEVKQLTDLTV

SEQ ID NO: 23509 - protein, 428 aa, Pirellula sp.
MTLIESIHARQILDSRGNPTVECEVTLMDGAAGRAAVPSGASTGMHEAWELRDGDKSVFMGKGVTTAVKNVNTKIADALEGMDATDQAAVDQAMIELDGTPNKKELGANAILGVSLAVAHAAAASTNQPLFRYLGGAGARMLPAPMMNIINGGEHADNGVDIQEFMVMPLGFERFSDALRCGTEIFHNLKKVLSDKGYSTAVGDEGGFAPDLKSNQEALDVIMTAIDKAGYKAGEQVWIALDAASTEFYDKSSGKYSLDNNQMSGDEMVDFLAGWCDKYPICSIEDGCDEDDWETWKKLTTKIGDKVQLVGDDLFVTNVERLQRGIDEGIANSILIKVNQIGTMTETIDAIQLAHRNGYTSISSHRSGETEDSTIADLAVAMSTGQIKTGSASRSDRMAKYNQLLRIEELLGDAAQYGGPLFAKRITG

SEQ ID NO: 23510 - protein, 159 aa, Pirellula sp.
MSLDPLDIDRHWMQRAIEMAQSAALEDEVPVGAIIVRSGTAIAAAANQREALHDPTAHAEMIAITQAAASIENWRLEQTTLYVTLEPCLMCAGAILQARVPRVVFGASDPKAGAVTSLYEVLTDSRLNHRCEITHGVMAEQCGHLLTEFFSAKRALGKK

SEQ ID NO: 23511 - protein, 559 aa, Pirellula sp.
MSPHPMTLLRRSMLRYKIGRLQRYLADAERARDIQRENLLHRIHQNADTAFGRDHGFSEIRTLEDFRRRVPIAGYEAARPYVDRVIQGETTALFPENTKVVMFATTSGTTDHPKMIPVTEDFYRQYKAGWQYWGTGVYRDYPHLLQMKSLQFSSHWNVTQTPSGAPCGNISGLAAETRPFYIGSLFVLPACVIQITEHLAKHYTALRLSLACDRVGKIVTANPSTLVEVAKFADTMKETLIRDIHDGTLTGDQPIPDAIRQQLRSRLRPNPRRARQLQQIVDRTGHLYPKDAWPDLTLLAVWTGGSVGLYLNQLPEYYGDAAIRDHGLSASEGRMTVPLQNGSPSGMLDYSSHHFEFIPESERDSKTPHVLEAWELTEGENYFIVLTTASGLYRYDIHDLVRCDGFCGQTPMLSFLNKGKNFCSFTGEKLSEHQVMQAMQQTLQSINAPSCTFTLAPTLGERPRYHLVLDDSSLPNLCERIGQELQNQLAQVNCEYADKCASGRIEPIQVTRVPAGTWEKLRASKTSKRGNFEEYKHPCLTNDPNFLQNLSKLDSASPS

SEQ ID NO: 23512 - protein, 697 aa, Pirellula sp.
MLLSLHYPFAPTPWHWHLSSRCIDSPRRIPFFRFSSSRATHRTRSLRRQSTTEERLRLAVSVAEFGIIEIDYLSGVAVADEKAAVLFGLPANQEVTREEVHRRFHPDDVFDIERKVKQSLEPDGTGEFATQHRVVHPKGEVRWVSVRKRIFFDEVDGKRVPVSGMVAAIDITEQKETEHNIRTGETRLKLAAEVTGFGTYDLDIRSSDCVWSDEIYRIFGIEIGETFTRTAMFDRVHPEDRARYRQLFLSLSGKDAKHSFKLEHRIVRPDGEVRWIINSGLLLFDERHPGSIPERVIGTMQDITDRKLFEQSLQDARDAAEAANRSRGEFLANMSHEIRTPMAAILGHADILRDHLRDPDNLQVVDTIRRNGNFLLGIINDILDLSKIDAGKLEVAKQPVRPDAIVAEVRSLMDVRAAEKKLPLQIEFDGPVPAVIHTDAIRIRQILVNLVGNAIKFTDEGVVRLTVRFDEANSCLQFHVIDTGIGIQSDEIDKLFDPFVQVDNTSTRSFGGTGLGLAICHRLAHALNGQVDVESQYGVGSRFTLSVKVDPDVQLVNPNLALSISADVPHGEIHLDAKVLVVDDRRDIRYLAQHFIERAGGEVVTATNGKEAVEFMETGDADDVDLIVMDMQMPIMDGYDATSELRKRGFELPIIALTANAMNSDRDVCLSVGCTDYTTKPLDSKLLIRMIDRLLTA

SEQ ID NO: 23513 - protein, 1122 aa, Pirellula sp.
MTDPDSPLIVGVGASVAGQEAFRLLAEASSRIVWIADCDGKFIEDSPSWRAFTGQTIDQLASTRWLDTVHPEDQRSVADALKDSRRDGGVSVEFRLRRHDGAFIGVQVQGVPQRQPEGSIDCWVLMSSAIDDPGTHQSKQASLSESAGQPKTARQSEAAEREAHLRRVINHQLGLVGVIDRDGILVEVDDRSLEIAKVARQDVIGKHFAEAPWWTYDPRVAARVREAMQRAFAGEVVRFDVSLFAYGEEGVRIDFMIAPVINDEGEVEFLIPSGTDIRDRHRAEVELRKSERLVRTIAENSTQGLVMMDATGHVIYCNQALLDMTGFDSEEIRSAPLHDLIHHHYPDGRPYPMSECPIDRALPEDFSVRAHEDLFFRKDGSSFSVVCAASPIFEDGKPVSTVIEVRDTTVQKAHEVELKRAAARLDKSLAFAGIAAWGWDHSEQRLILDVPLRRMWGFDDEQDVTLDDFAQRITPNHRDRVVASITNAMKTFSSYREEYTIDLPSGNQRWIRAIGQVVADGNGGIADFFGVTMDVTADLRRQVKARVRSELLEQLSELTDPEAIMQLATQRIRKHFSASRCYLAYIRLDAQTTEVFHESHDEHLSPIVGTHQIRDFLNDHEMREIESGKPVRIDDISQSGRSSEKVQQFADLGIAAVTQGSFEATKVLHRTLFITKDKPYRWRDDEVRFLDNLTEMVYLRIERAESQLELEQARAVAEAASQSKSAFVANMSHEIRTPMTAILGYADLVRDMIEDPQAIEHLETIRRNGDYLLEIINDILDLSKIEAGKLEVNHEKFEPARLIEDVRSIMEVRAKEGGLSLDVQYIGLLPKTIESDGKRLKQILINLVGNAIKFTQKGWVQIRVRFNKLLHIDIVDTGIGMSDEQQKRLFKPFSQGDASVTRTFGGTGLGLAISKRLTEMLGGTIIASSTEGVGSTFTVSVAVGDLADVAMVDYSHTFDADHDETSSKYADGSLGTGVNRLAGVEKPLRCHVLVVDDRHDIRFLSRALLTKAGATVDECEDGQLAVDYMTDRLNNDDCPDLILLDMQMPNLDGYETARTLRRMGYSGWIIALTADAMQGDMNECLEAGCNDYLSKPIDANRMIGLIAQFTQSNSDAVERKGN

SEQ ID NO: 23514 - protein, 953 aa, Pirellula sp.
MESLRKAAIEDELGKPNPDQDGNNQRVVAFAPTQQDAKLCAKILAENDVAVCCCETIEGFANTILEGAGIALIAQEHLTDAAIAYLKTSLDRQPKWSEVPILVLLQAGDPDSKLLKRVLSLEHVTLINRPLRIAVFINTVRAKLRDRMRQFEVRDLLLEKDRAQTSLRREARRLDMAIQAGGMAAWEWSKTHVYWSEAFRRLHGFGKNVQPSESAMFGSIVESEREQIANHWSDAIEQNAPFRSEFRINHPKLGERWLVAVGEPVKGKSGKTLRYTGLQWDITERKTAEMELRQSHETFQRLITDNPQGLYVVDADFRMRYVSAGARSVFVNAEPLIGKPFEDVMRTIWPNDFAEEAIRVFRHTLETGEPYVAPPLVEQRVDTNETEAYDWSIERIVLPDNRHGVVCHFYNNTQRQLSVDLLRESERYFREIADASPAMLWVTDENHMCTFLSKNWYDTTGQTPEEGMGLGWTNATHPDDHARVGEEFLTAANARQAVLSEYRLRMADGTYRWAVDVGRPRFDSDGVFVGYTGYVIDVDDRKAFEQSLEQAKVIAENANRSRGEFLANMSHEIRTPMAAILGHADILKDHLRDPDNIQVVETIRRNGNFLLNIINDILDLSKIDSGKMQLETDRVRPDGLLAEVRSLMDVRASEKHLPLKIEFDGPIPDLIETDAVRLRQILLNLVGNAIKFTDSGEVKILVGYDGPGKRAAEIDQSDPSKLQSPVAGTCRLIFQIVDTGIGIKPEDQASLFEPFVQADSTSTRSFGGTGLGLAICRRLAHALGGDVSVESTYGKGSKFTLTIEAVSSGRLVEPNLLIDVSAEKIKEEIRLSANILVVDDRRDIRYLAQHFIEKAGGTVVTATNGQEAIDTIFAEPKAEIDLIVMDMQMPVLDGYDATAELRRRGCELPVIALTANAMKSDRDECLAAGCTDYTTKPLDSQKLIAMIDRLLKS

SEQ ID NO: 23515 - protein, 203 aa, Clarkia concinna
RHELSMLCDAEVALIVFSTKGKLFEYSTDSSMEKILERYERYSYAERQLATNDSDPQGSCWTFECPKLMAKIEVLQRNIRHYVGEDLDPLSQRELQSLEQQIDTAIKRIRTRKNQLMHETISELHKKEKVLQEQNNLLSKKLKDNENALAERAQREQEFGQNTSNFMFPPATPPLLLHSLTIGGTFQGNVAPGKENEAQVRPS

SEQ ID NO: 23516 - protein, 217 aa, Chelidonium majus
  unsure (1)..(217): unsure at all Xaa locations
VKKAHEISVLCDAEVGLIVFSTKGKLFEFSSESSMDNILERYERQCFVEEELKATHPESEGNWSLEHTKLKARIEILQKNQRHFMGEDLDPLSLKELQNLEHQLDIALKHVRSRKNQLLYASIAELRKKEKALHEQNILLGKKIKQKEEQIAQWSAQQNDAQNSSSFLTQAPQNSQSFLTQALPSLTLRTGYYQTARVVVCEEDGARSNMXMPPWML

SEQ ID NO: 23517 - protein, 219 aa, Chelidonium majus
  unsure (1)..(219): unsure at all Xaa locations
GLVKKAHEISVXCDAEVALIVFSTKGKLFEYSTDSGMERILERYERYSYAERELVASELDQGNWSLEYTKLKAKIEILQKNQRHFMGEDLESMSLKELQNLEQQLDTALKQIRSRKNQLMYESISELQKKEKVLQEQNNQLGKKLKEKEKEVAQQQAQWDQQSQGQSSPSFLLSQSLPSLNIGGSYHMRGSNGSEEEGVRPQTTRTNTTLMPPWMVHHL

SEQ ID NO: 23518 - protein, 218 aa, Corylopsis sinensis
GLVKKAHEISVLCDAEVALIVFSTKGKLFEYSTDSCMEKILERYERYSYAERQLVATDPNSQGNLSLEYSRLKAKVELLQRNQRHFLGEDLDSLSLRELQTMEQQLDTALKRIRSRKNQLMYESISELQKKEKAMQEQNNMLAKKIKEKEKTMTQQAQWEEQNQDPGAASFLLQQPLPCLNIGNTYNQGVGGGAPEVRRNELDLTLEPVYPCHIGCFA

SEQ ID NO: 23519 - protein, 229 aa, Corylopsis sinensis
VQLKRMENKINRQVTFSKRRAGLLKKANEISVLCDAEVGLIVFSTKGKLYDMERIFDRYERYSYAERQLVVTNHESQGSWTIEHAKLKARMEVLQRNQRHFMGENLDSVSLKELQNLEHQLDNALKHIRSRKNLLMQESISELQRKDKSLQEENNSLSKKIKEKENALAHRAQWEQQNQGLNSFPILLSQPPQSLNIGTYQTGCSEGEEGTPFQQRPNTLLPHWMVSHL

SEQ ID NO: 23520 - protein, 236 aa, Heuchera americana
VQLRRMENKINRQVTFSKRRGGLVKKAHEISVLCDVEVALIVFSNKGKLFEYSTDSCMEKILERYERYSYAERRLVATGSESQENWSLEYTKLKAKIELLQRSQRQFMGEDLDLLSLRELQNLEQQLDTALKHIRSRKNQLMNQSISDLQKKEKAIQEQNNLLAKKIKEKEKAMSQQAEWEQQNNGASTSNFLNPQPLPCLNISSTYQGGAQPEAMRRNELDLTLEPIYSCHLGCF

SEQ ID NO: 23521 - protein, 216 aa, Heuchera americana
ELSVLCDADVALIVFSTKGKLFEYSTDSSMEKILERYERYSYAERQLIATDSELQGNWSLECPKLMARIEVLQRNIRQYMGQDLDPLSLRELQNLEQQLDSALKRIRTRKNQLMHESIAELQKKEKALQEQNNQLAKKIKENEKTVGENAQWQQPNQGHTSSSFMLAPALPPPSLQLPSLNIGDTFQARGVMNGDAGAQTRPSTNTLMPPWMLRHL

SEQ ID NO: 23522 - protein, 205 aa, Heuchera americana
SVLCDAEVALIVFSTKGKLSEYSTDASMERILERYDRYSLAEKQIAGTDAEAHGSWTLQYAKLKARMEVLDKNLRHYRGEDLDSLNLKELQTFEHQLDVALKHVRSRKNNLMHESISELQRKDKAIQEQNNLLTKKIKEKEKELAELAQCEQPNQGLESVLPSQPFQSVDTGSSFQTAGNGGEVETSTSLNRTNSLLPHWMVSHL

SEQ ID NO: 23523 - protein, 210 aa, Heuchera americana
  unsure (1)..(210): unsure at all Xaa locations
SVLCDAEVALIVFSNRGKLYEFCSTSNMLKTLERYQKCSYGAVEVNRPCKELESSYREYLKLKGKFEGLQRTQRNLLGEDLGPLNTKELEQLERQLDSSLKLIRSTRTQFMLDQLSDLQNKEQVLMDSNRSLARKLDEISAKNNNLRLSWEGGEQSIPYSQQQAQPQGLFQPLDCNPTLQIGYNSIGSDPDDYXQLMHRMSTGFMPSWML

SEQ ID NO: 23524 - protein, 214 aa, Michelia figo
  unsure (1)..(214): unsure at all Xaa locations
RPCAEMSMLCDAEVALIVFSSRGKLYEFGSAGVNKTLERYQRCCYTFQDANITDRDTQGWYQEVSKLKAKCDSLQRSQRHLLGEDLGPLSVKELQKLERQLESALTQTRQRKTQIMLEHMEALREKERQLGDINKELKNKLEAKGQGAFRAMQASWESGPLVGNNGFPMHPSQSAAIECEPTLQIGYHSFAAPEASIPRTVVAESNFMPXGMLC

SEQ ID NO: 23525 - protein, 206 aa, Michelia figo
  unsure (1)..(206): unsure at all Xaa locations
VQLKRMENKINRQVTFSKRRNGLLKKAYELSVLCDAEVALIIFSSRGKLYEFGSAGTNKTLERYQRCCYTPQDVVVSDRETQGWYQEVSKLKAKYESLQRSQRHLLXEDLGPLSVKELQHLERQLEVALSQARQRKTQIMIEQMEELRKKERQLGDINKQLKIKLEAEGQGPFRCIQGSWESGAMVGNNTFSMNAPQAAPLDAXSP

SEQ ID NO: 23526 - protein, 208 aa, Michelia figo
  unsure (1)..(208): unsure at all Xaa locations
GLVKXAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRKNQIMFDSIAELQRKEKSLREQNNMLEKEIQEKEKAMAQQVQWEQQNQSQSSPSFLLPTLNIGTYHRGNEVEEEGARPPARTNSLMPSWMLC

SEQ ID NO: 23527 - protein, 239 aa, Phytolacca americana
  unsure (1)..(239): unsure at all Xaa locations
VQLRRMENKINRQVTFSKRRSGLVKKAHEISVLCDAELALIIFSPRGKLFEYSTDSSMEKILERYERYFYAERQLASNDPNTEVNWTFDFAKLKAKLELLQRNHRHYLGQDLDSLNIKDLQSLEQQLDNALKHIRTRKNQLMHESISELHKKEKAMQEQNNMLVKKIKEREKAMAEAQGMQWQRQQNEPPEASNFLLPPPLTSWNTAGDAYHGQIAGEVKRNDLDLTLEPVYSCXXGCF

SEQ ID NO: 23528 - protein, 205 aa, Phytolacca americana
SVLCDAEVALIVFSTKTKLFEYATHSSMERILERYESYSYAEKQLVATDSESRQQGSWAMEYPRLVSKLEVLQKNMRHYVGEGIESLTLRELQHLEPQLDTALKRIRTRKNQLMHESISQLQKKQKTMQEHNNLLVKLVKEKDKTQATQKENPRELLMLSSNPLPFPSLSIGGAYQEREMGIKQVIHQSEPNTSSAMPHWMLHHL

SEQ ID NO: 23529 - protein, 212 aa, Phytolacca americana
SVLCDAEVALIVFSTKGKLFEYSTESSMEAILERYERYSYAEKQLVATDSESQQQGSWAMEYPRLISKLEVLQRNMRHYVGQDIDSLALRELQHLEQQIDTALKRIRNRKNQVMHESISQFQKKEKAMQEQNNLLVKLVKEKGKTQVIEEENPSQALMLSSSNPLSFPSLSIGGSYQERTEMGVEQVHYQGQGQVVPPNSNTTMPPWMLRHL

SEQ ID NO: 23530 - protein, 226 aa, Phytolacca americana
GLVKKAHEISILCDADVALIVFSTKGKLFQYATGSCMEKILERYERYSYAERQLITPDPESHLSWTLEHAKLKARVEILQKNQRNYMGEELDTLSLKELQTLEHQLDSALKQIRSKKNQLMYESISQLQKKDKALQEQNKSLSKEVKEKEKEKEKTMTQQAQWDNQNQDINSSSCLMSDQALPSLNIGMNYQTESGSSSVENEAIQQQNRNNTTIALMPHWMLSHL

SEQ ID NO: 23531 - protein, 215 aa, Pachysandra terminalis
GLVKKAHEISVLCDAEVALIVFSTKGKLFEYSTDSCMDQILERYERYCCAERELGAADTESQGSWTQEYTKLKSKIEVLQKNLRHLKGEDLESLRLKELQNLEQQLDNSLKHVRSRKNQLMHDSISELQKKEKELQEQNNMLNKKLKEKERAKTQQAQWEQQNQGPNSPSLQLSQPLPFLNIGGTYQTRSTRNQEEGGRPHHSNRTDALMPHWMV

SEQ ID NO: 23532 - protein, 234 aa, Pachysandra terminalis
  unsure (1)..(234): unsure at all Xaa locations
VQLRRMENKINRQVTFSKRRTGLLKKAHEISVLCDAEVALIVFSTKGKLSQYSSNSSMETILDRYERYSYAERKLMAGDHLDSQGSWPLEYTKLKSKIEVLQRNQRHFMGEELDSLSLKELQYMEHQLDTSLKHIRSRKNQLMNDSIYDLQKKEKALQEQNSTLIKKLKEKEKAPAHQACWEQQGQNLPSFLLSQPLPSLNIGXNYXLARXSRDEEEGAQSHARTNPIMPPWML

SEQ ID NO: 23533 - protein, 238 aa, Pachysandra terminalis
VQLRRMENKINRQVTFAKRRNGLLKKAYELSVLCDAEVALIIFSARGKLYEFCSSSSMQNTLERYQKCSYGPLEPSQPAKETQSSYLEYMRLKARVEGLQRSQRNLFGENLGPLSTKELEQLEHQLEMSLNQIRSTKTQFMLDQLSDLQRKEQMLQEANRSLKRKLEESNAENSLGPSWESGGHGVPFGHQPAQSEGFFQPLECNSTLQIGYNHVGADQMSITVPPQNVNGFVPGWMV

SEQ ID NO: 23534 - protein, 238 aa, Peperomia caperata
  unsure (1)..(238): unsure at all Xaa locations
VQLKRMENKINRQVTFSKRRTGLLKKAHEISVLCDAEVALIVFSTKGKLYEYATNSSSMPGILDRYERHSFTDKEFFIKEGEPPEGAWTLEYAKLKARYELLQKNYRHYLGEDLGSLSGKELQQLEGQLDASLKNVRSRRTQALFHTISDLQKKEKSLLEQNSVMIKKLQDLEKAEKAQQSQLEMQNHERTQNQPPLILLPPPALSXGSFRQENGPSVEGEAAPRVAQKNSLLPPWMX

SEQ ID NO: 23535 - protein, 206 aa, Peperomia caperata
SVLCDAEVAVIVFSTKGKLYEYATDAGMARILDRYEKHTFSNRELELTNLESEGAWSLEYGKLKARFELLQKSHRHYLGEDLGALNMKELQHIEHQLDSALRHVRSRKNQILSDTISDLQTKEKLIHEQNKILQKRIQEKEREITGQPQWEIVPSRQENQNPQPTLFPIPLHTLSIGYCKEDGKAIELGLENEPRPLSQKMPPWML

SEQ ID NO: 23536 - protein, 199 aa, Pisum sativum
SVLCDAEVALIVFSNKGKLYEYSSDPCMERILERYERYSYAERQHVPNDQPQNENWIIEHAKLKARLEVIQKNQRNFMGEELDGLSMKELQNLEHQLDSALKQIRSRKNQVVYESISELQKKDKALQEKNNLLTKKIKEKEKALAQLELHNDDMDLDSTALVPQPLETLNIGCSPQDRGDNEGSQTQSNALLPHWMLRH

SEQ ID NO: 23537 - protein, 214 aa, Petunia x hybrida
AHELSVLCDAEVGLIVFSTKGKLFEYSTDSCMERILERYERYSYAERQLSGATDNDTPGSWTLEHAKLKARLEVLQRNQKHYAGEDLDSLSMKELQNLEQQLDSALKQIRSRKNQLMHESISELQKKDKALQEQNNKLSKQVKEREKELAQQSQWEPQSHDLNSSSFVLSQPLNSLHLGEAYPSAGDNGEVEGSSRQQPPNTVMPPWMLRHLNG

SEQ ID NO: 23538 - protein, 215 aa, Papaver nudicaule
  unsure (1)..(215): unsure at all Xaa locations
RHEMSMLCDAEVALIIFSNRGKLYEFCSSNSMFKTXERYQKCNYGQPEPNVSARESLEHASHQEYLKLKARVEALQRSQRNLLGEDLGPLSGKELEFLEKQLDSSLKQIRSTRTQYMLDQLTDLQRREQMLSDANKTLRRRLEEGAQASQQQWDMQHGVGYSRQQQSXHHQAADHNQGFFHPLECEPTLQIGYQQDQITVAQGAPMGSYMPGWLA

SEQ ID NO: 23539 - protein, 219 aa, Papaver nudicaule
EMSVLCDAEVALIVFSTKGKLFEYSTDSGMDRILERYERYSYAERELVTTEIDQGNWSLEYSKLKSKIEILQKNQRHFMGEDLQSLSLKELQNLEQQLDVALKQIRSRKNQLMYESISELQKKEKALQEQNNKLGKQLKEKEKEVAAQQQQASQWDQQVTQGQSSPSFLLSQSLPNLNIGNGSYQVRGGNNGNEEEIRTQTTRTNTATPMPHWMVNHLR

SEQ ID NO: 23540 - protein, 201 aa, Papaver nudicaule
DAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPSLNIGGNYQGRSSGREDEVPQTQARPTILMPSWMLC

SEQ ID NO: 23541 - protein, 210 aa, Papaver somniferum
SVLCDAEVALIVFSTKGKLFEYSTDACMDAILERYERQCCVEEELVGTDQESQGNWSLEHAKLKAKVEVLQRTQRHMMGEDLESFNVKELQNLEHQLDTSLKHIRSKKNQLLYASISELQRKEKALQEQNTILGKKIKEKEQEMGRLDQQQQSNQAQNSCSQAQNSAQNSPTFLLSQELPSLTICTGTYEPAARPIAIQTVMPPWMLRHL

SEQ ID NO: 23542 - protein, 240 aa, Papaver somniferum
VQLRRMENKINRQVTFSKRRSGLLRPCAEMSVLCDAEVALIVFSTKGKLFEYSTDSGMDRILERYERYSYAERELVTTEIDQGNWSLEYSKLKSKIEILQKNQRHFMGEDLQSMSLKELQNLEQQLDVALKQIRSRKNQLMYESISELQKKEKALQEQNNKLGKQLKEKEKEVAAQQQQASQFSQGQSSPSFLLSQSLPSLNIGSGSYQARGGDNGNEEGNRTQTTRTNTATLMPPWMLN

SEQ ID NO: 23543 - protein, 209 aa, Ranunculus bulbosus
  unsure (1)..(209): unsure at all Xaa locations
AHEISVLCDADVALVIFSIKGKLXEYSTNDRMEGILERYERYSYTSTELVAADPESQECLSMEYXKXKSKVEALQRSQRYFMGEDIGSXGVKELQALEQQLDTSLRQIRSRKNQLMAGSITELQKNEKALLEENIXLKKQAKEKELALSLCEQLNPVERSPYVPLPDAVPALNTSEPTNQSSGSXGEEEVXAQPSQTKTLMPPWMLHHL

SEQ ID NO: 23544 - protein, 214 aa, Ranunculus bulbosus
  unsure (1)..(214): unsure at all Xaa locations
KAHEISVLCDADVALXIFSIKGKLXEYSTNDXMEGILERYXRYSXTSTELVAADPESQECLSMEYNKLKSKAEALQRSQRHFMGEDIGGLCVKELQALEQQLDTSSRQIRSRKNQLMAGSIIELQKNEKALLEENINLKKQAKEKELALSLCEQLNPVERSPYVPLPDXVPALNTNGPTNQSSGSGGXGGGGEEVVAQPPQTKTPMPPWMLXHL

SEQ ID NO: 23545 - protein, 194 aa, Ranunculus acris
HEMSVLCDADVALIVFSIKGKLTEYSTNDSMESILERYERYSSSCKELPATDPESQECLFRDYNKLKSKVEALQKSQRHLKGEEIGGLGVKELQALEQQLDTSLRQIRSRKNQLMNGSITELHRSSKALHEENVNLKKQAKEMELALSVYKKHNQAPLNVSGTSTQSSETQGEGDVVQPLRAKTLMPPWMLNHL

SEQ ID NO: 23546 - protein, 216 aa, Ranunculus bulbosus
  unsure (1)..(216): unsure at all Xaa locations
GLVKKAHEISVLCDAEVALIVFSTKGKLFEYSTDSGMDKILERYERYSYAERELVTNDTDSQGNWSLEYTKLKAKVEILQKNQRHFRGEEIGNLGLKELQNLEQQLDTALKLIRARKNQLLFESISEYQKKEKALNEQNNQLEKQLKEKEKELAKRPQWEQPPNQGQTSQSFTLQSHPCLNIGGNYQGGSSGREDEVPQTQARPTILMPPWMVXHL

SEQ ID NO: 23547 - protein, 207 aa, Ranunculus bulbosus
RHEMSGVCDAEVALIVFSTKGKLFEYSTDSGMDKILERYERYSYAERKLGASDTDSQGNWSLEYTKLKAKVEILQKNQRHFRGEDIANMSLKELQNLEQQLDSALKLIRARKNQLTYESISDLQKKEKVLQEQNNQLEKQLKEKEKELAKREQWEQPNQGQTSRSFTPQSPSSLNIGGSYQGNNGGEGFQTQNRPTILMPPWMLSHL

SEQ ID NO: 23548 - protein, 215 aa, Ranunculus bulbosus
ALRHEMSVLCDAEVGLIIFSARGKLYEFASAGGMSRTLERYHKNSFSNQDSNLAIDRETQSWYQEVSKLKAKYESLQRSQRHLLGEDLGPLNVKELQNLEKQLEGALAQARSRKTQIMLEQMEALRRKERELGDMNKQLKNKYQLEAEGQGSLRAMQGSWESNALNNYSGHPSHSSSMDCEPTLQIGYHQYVSADGGPIQRNNAGENNFIQGWEL

SEQ ID NO: 23549 - protein, 210 aa, Syringa vulgaris
SMLCDAEVALICFSYKGKLFEYATDSCMDRILEKYERYSFAERQLVTNEPQSPANWTLEYSKLKARIELLQRNHSHYMGENLDSMSLKELQNLEQQIDTALKNIRSRKNQQLHESISEMQKKEKALREQNNMLEKKIKEKEKEMAVQPQWGLPNHGANGPQFLLAPQLPGLNIGGAYEGESAEATRNELDLTLEPVYNCKGEFQHTGGRY

SEQ ID NO: 23550 - protein, 232 aa, Syringa vulgaris
  unsure (1)..(232): unsure at all Xaa locations
RMENKINRQVTFAKRRNGLLKKAYELSVLCDAEVALIIFSNRGKLYEFCSSSSMLRTLERYEKCNYGAPEPHVSSREALELSSQQEYLKLKARYEALQRSQRNLLGEDLGPLNSKELESLERQLDMSLKQIRSTRTQAMLDTLTDLQRKEHALNEANQSLKQRLMEGNHISLQWNQDPEEVGYGREPTQHQPHGFFHPLECEPTLQIGYQNDPMAAAGPSLNNFMSGWLPXI

SEQ ID NO: 23551 - protein, 207 aa, Syringa vulgaris
ALVQLRRMENKINRQVTFAKRRNGLLKKAYELSVLCDAEVALIIFSNRGKLYEFCSTSNMLKTLERYQKCSYGSLEVNNSTRDLEESSNREYLKLKSKYESLQRHQRHLLGDELGPLNINDLEHLEHQLETSLKHIRSTRTQVMVDQLSDLQAKEKMMVETNTALERKLEEIYAANQLQQSWAGGEQSCAYSQQHLNLRTFFNLWMQ

SEQ ID NO: 23552 - protein, 242 aa, Syringa vulgaris
  unsure (1)..(242): unsure at all Xaa locations
LVQLRRMENKINRQVTFSKRRNGLLKKAYELSVLCDAEVGLIIFSSRGKLYEFGSAGMTATLERYQRCCFNPQNAGAGAERETQSWYQEVSKLKAKYESLQRTQRHLLGEDLGPLNVKELENLEKQLEGSLSQARQRKTKIMMEQMEDLRRKERQLGEMNKQLKIRVSLELSSHETEGQGLRGFPCQXNAAASAGTSNFMAQPGTNPMEFEPEPVLQMGYHHYNLGEGPLFQDHGYRSFDLF

SEQ ID NO: 23553 - protein, 203 aa, Tradescantia virginiana
  unsure (1)..(203): unsure at all Xaa locations
LCDAEVGVIIFSNRGKLYEFCSGPSMMKTLERYEKSCFAGPDQNTQVKENQLVHSSRQEYLKLKARLDTLQRSQRNLLGEDLGSLSVKELDYLEKQLEMSLTEVRSTRTQQMLDQLTDLQRRESQLCDANKFLRKRLEELYQANGEQVWQIVPICHLTRHKTLRHVFFHPLECPPPTLQIGYDQSEQMPGPSVSNFMPXWMLC

SEQ ID NO: 23554 - protein, 241 aa, Tradescantia virginiana
  unsure (1)..(241): unsure at all Xaa locations
VQLKRMENKINRQVTFSKRRGGLLKKAHEISILCDAEIALIIFSTKGKLYEYATNSKMDNILERYERYSYAEKALTSSDPDIQGNWCQEYAKLKSKVEALCKSQRHLMGEQLETLNLKELQQLEQQLEGSLKHVRSRKTQVMLDSISELQRKEKSLEEQNKNLEKEILEKQKIKALAQQAHWEHQNQPAPRGSPPRPFVIAESHPTLNIGHFQGRTNAVEAEENQQPXMRICSSLLPPWML

SEQ ID NO: 23555 - protein, 222 aa, Tradescantia virginiana
  unsure (1)..(222): unsure at all Xaa locations
GLVKKAHEISXLCDAEVALIIFSTKGKLYEYATDSKMENILERYERYSYAEKALTSSDPELQGNWCQEYVKLKAKVEALHKSQRHLMGEQLEALDLKELQQLEHQLEGSLRLVRSRKTQMMLDSISELQRKEKSLEEQNKNLEKEILEKQKEKALAHQAHWEQQNQPLQSTNSPPRPFVIAETHPTLNIGNFQGRTNTVHAEESLQRQMRISSSLLPXWMXH

SEQ ID NO: 23556 - protein, 199 aa, Tradescantia virginiana
GLVKKAHEISVLCDAELALIIFSPKGKLYEYATDSKMEIILERYERYTYAEKALIASDPDVQGNWCHEYIKLKAKFEALNKSQRHLMGEQLDTLNQKELLQLETKLEGSLKNVRSRKTQLMLDSISELQEKGKSLQEQNTCLEKEILGKQKDKAPKQHVQWEKQNQPPPTSSAPMPFLIGDIHPTPNIRNFQGRTVADA

SEQ ID NO: 23557 - protein, 235 aa, Tradescantia virginiana
VQLKRMENKINRQVTFSKRRTGLLKKAHEISVLCDAEVGLIIFSTKGKLYEYSTDNSMAKILERYDRYATAERAVLEANLNLEVGSHYEYRKIKAKVDALQKSQRHLMGEQLDTMTNKELQQLEQQLETALKHIRSRKNQMMLESVAALQKKEKALREQKSILEKKLIEKQKDMEISQIHQYQAHEDNTSPTSLVLTNSLPTTLNTNGCITHAIEEEHAPTLPHTNNNNLPPWMV

SEQ ID NO: 23558 - protein, 226 aa, Paeonia suffruticosa
SQVTFSKRRGGLLKKAHEISVLCDAEVALIVFSTKGKLFEYSTDSSMEKILDRYEQYSIAERQLVEEPGSQGNWSLEYSKLRAKIELLQRNQRRFMGEDLDSLSPKDLQNMEQQLDVSLKNIRSRKNQLMYESISELQKKERAIQEQNNLLAKQIKEKEKTMAQQAQWEQQIHHGPNASAYLLSPHELTTLNMGGNYQGEPTEMRRNELDLTLEPIYTCHLGCFGA

SEQ ID NO: 23559 - protein, 491 aa, Brassica napus
  unsure (1)..(491): unsure at all Xaa locations
MAASYEAERDVQKNYWIEHSADLTVEAMMLDSRAADLDKEERPEVLSLLPPYEGKSVLELGAGIGRFTGELAQKAGELIALDFIDSVIKKNESVNGHYKNVKFMCADVTSPDLNITDGSIDLIFSNWLLMYLSDKEVELLVERMVGWIKVGGYIFFRESCFHQSGDSKRKSNPTHYREPRFYTKVFQECVTRDAAGNSFELSMIGQKCIGAYVKNKKNQNQICWIWQKVSSENDRGFQRFLDNVQYKSSGILRYERVFGQGFVSTGGIETTKEFVEKMDLKPGQKVLDVGCGIGGGDFYMAENFDVHVVGIDLSVNMISFALERAIGLNCSVEFEVADCTTKHYPENSXDVIYSRDTILHIQDKPALFRTFFKWLKPGGKVLISDYCKSSETPSPEFSEYIKQRGYDLHDVQAYGQMLKXAGFNDVIADDRTDQFMQVLRRELERVEKEKEEFISDFSKEDYEDIVGGWKAKLERSASGEQKWGLFIANKN

SEQ ID NO: 23560 - protein, 139 aa, Oryza sativa (japonica cultivar-group)
MTKYKGVRQRHWGSWVAEIRHPLLKTRIWLGTYGTAEDAARAYDEAARLMSGPAARTNFPLSSSGGNARSCLSPTLRARLEKCCGAGSSAQAQQGAVAGQDNDDAAAAAAAMGVDDGDEYVEEMIQELTFYGSIEIVQP

SEQ ID NO: 23561 - protein, 331 aa, Oryza sativa (japonica cultivar-group)
MAAVPEVALRHGAGRPMPAVGVGTADSAATSPETKRGAALAALEVGFRHFDTAALYGTEAPLGEAIAEATRRGLVASREEVFVTTKLWCTQCHPGLVLPSLRESLRNLQMEYVDLYLVHWPISVKPGPPMLPVKREDAVPFDFEGVWRAMEECHRLGLAKAIGVSNFTTKHLDKLLAVATIPPAVNQVEMNPVWQQRTVREYCAAKGIRVAAYSPLGGQNWIGEGNDVMESPVLADIARARGKSIAQGRIQIPGQVSLRWIHEQGVTPIPKSYNKERLKQNLEIFDWELTKEDRLKISQIPQKKIVTAARMFSPDGEFASVDLSDMEIVEE

SEQ ID NO: 23562 - protein, 229 aa, Oryza sativa (japonica cultivar-group)
MRIQCDACEAAAATVVCCADEAALCARCDVEIHAANKLASKHQRLPLDAALPAALPRCDVCQEKAAFIFCVEDRALFCRDCDEPIHVPGTLSGNHQRYLTTGIRVGFSSVCSANADHLPPPAPKGNSKPPASGIAAAAAPKPAVSAAAQEKGSPIGFKDLEWLDDIDLFHVQSPAKGGSTAAEVPELFASPQPASNMGLYKASGARQSKKPRVEIPDDDEDFFIVPDLG

SEQ ID NO: 23563 - protein, 350 aa, Oryza sativa (japonica cultivar-group)
MENGGGDVPENANDHCPGTQSEAAGKADACAGCPNQQICATAPKGPDPGAITHLLAIIERMNTVKHKILVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQIAGIDGAIIVTTPQQVSLIDVKKEINFCKKVGVPVLGVVENMSGLRQAFSDMKFVKPSEAGETDATEWALNYIKEKAPELLSVVACSEVFDSSKGGAEKMCQEMEVPFLGKVPMDPQLCKAAEEGRSCFTDQKCSASAPALKSIIKKLVKTK

SEQ ID NO: 23564 - protein, 410 aa, Oryza sativa (japonica cultivar-group)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVQDTTTIGEGKMFSPGNLRATFDNPEYDKLINYYVKEKYTLRYTGGMVPDVNQNCYEKYEMPTLMGSFMMQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 23565 - protein, 78 aa, Gossypium hirsutum
PKRPAGRKKFRETRHPVYRGVRRRNPGKWVSEVREPNKKSRIWLGTFPKADMAARAHDVAAIALRGKSACLNFADSAW

SEQ ID NO: 23566 - protein, 931 aa, Pseudomonas aeruginosa
MKLKNFLQPFDSGFSTPSAALKLLRMLGGALMLCVLCSLIFSVSMVLNHQVSLSRQAMNVAMYEAQLYFEQREALLNHLSGNVVPLAAGRALVNEAPNNVSILPLSDGGRGLLLTARTLGDLREKRLALMYLVDTDKGPLVYRLTADGRPSAAISSTITKEVYRALLATPSAPVHWVTDGGTPQRLYLFESLGDEPGEGWLGLEILGEDLDSMLRRNDAGNYMLLDQHGQVVLATDAEALGSGASRTLLRGDGFGFIGAGPLPQHMVLFQHVGSSSWDLIYHIGIGRLLLALWLPLLLASALALAVGILLHWLVRSIERRLIEPAKRRLEALKESEAFSRAVIQAAPVALCVLRRADAAVVLENPQARQWLGDSEAIAHDAPRWISQAFAGGVKCSGEELETEAGLHLHLNYTPTRYNGEDVLFCAFSEISARKRMEAELARAKSLADAANEAKTLFLATMSHEIRTPLYGMLGTLELLGRTELSRQQAGYLKAIQHSSSTLLQLISDVLDVSKIEAGQLDLECVEFSPLELTEEVVQSFTGAAQAKGLQLYTCLSAELPLRMRGAAASIRQILNNLLSNAVKFTDNGYVNVHLKASVVDAECVMLTWQVNDTGMGINVEDQPRLFEPFYQIRRSEHPVAGTGLGLSISQRLAQLMNGSLKLVSELGLGSSFSLRLPLERIAMQAEPQDLAGCAVQVLAPVRDLTECLCGWISRWGGRAMVATPRSLDEADATSLLVKVLLLEGAPMFEAWPGCRVELSPQGDMEPQAQGRDWLLGLNNLNGLHRALGLAHGRLADPSTPPIRLAPLRNLGLRVLVVEDNAINQLILRDQMEALGCSVELLFDGREALLHCQTACFDVVLTDINMPNMNGYELTAELRRQGFRQPIIGATVNAMREERERCMSAGMNDCLVKPVDLNALQNCLINILKVDR

SEQ ID NO: 23567 - protein, 1084 aa, Pseudomonas aeruginosa
MKSASALEHDNKLLLKWTTLSQSLSIGLICVVVLTVLLFSICYWSLGRLFQEEEDKVSFHFTRMMDVIREHEVFLGRIARKSDKTTQKYDYDVVPLQRHLLAKENGLAVYEGREFSFAMPFLLATKHALSADSSGDPFSLGVLLANFYGSFWSVSAYPAPQLLIFDLSGSTRLAVPSIPSTAQRDRLSGSYPMIVERILARLRTRPVGEDAQRVHWIRADRYRDSALEMLGVARVDLPETLWWHDEPNHLIIAASLLDLRRINDFEQLVERPAFDSYSLVSPDGEVLLGAAPATGLRDGLNLTRQGVAVQLLSQPENGWLAVYRTDYGNFFRHSRWLVAGLLLTPALLLAGWLGMRWYTSSVVNPVHRAHRQLVESDTFSRTLIQTAPVALVVLTQDDQQLVTCNHLAAQWLGGPTEILGLTSNWKLFDARGQVPGDICIQVGGRYLQTAFAATRYAGTEAVLCVFNDITVHCEAETALSNAKRAADAASQAKTLFLARMSHEIRTPLYGVLGTLELLDLTTLNERQRAYLRTIQSSSATLMQLISDVLDVSKIEAGQMALTLAAFNPLDLVREVLGNFAASAMAKDLQFYACIDTEVPAQLIGDVTRIRQVLNNLVNNALKFTDIGRVVLRVKLLSRNDGRALLQWQVADTGIGIAHEQQERLFEAFYQVSGAHHAGGTGLGLSICWHLAEMMGGHLRMVSETGLGSSFSLVLELPEDEQSGLACRPGLLKSACVHVRSPVRELADSVGAWLKAWGCKVSSGEAAPSELETCVLLELLPMAAGPASSPWPGPRVRASMDAPCQPELREDGWRVGLHNLAGIGQALAQALGGDIPEQTPANACARSGRLDLEVLVAEDNPVNQALLREQLEELGCRVSLAGDGRQALQLFDSGRFDLLLSDVNMPNMTGYELTQALRERGETLPIIGVTANALREEGERCRAVGMNSWLVKPITLHTLHELLSEFARAGVVLPAQARDLGPPAQLDDGLSPQVPERMRALFLETMGKDLEAARQAIRRNDPKGLQQDLHRMAGSLAVMRARTLVVMCQGAEEGLLESRLECSAVEIGEVLVHIEQALEFVRKTG

SEQ ID NO: 23568 - protein, 418 aa, Arabidopsis thaliana
MLLLVDCSSCRTPLHLPPGATRIRCAICHAFTLIAPEPRLQSHASASPFPFPNSSPAPSTFIYPPPTPSPYTHAPHAPSPFNHAPPDSYPFTHAPPASSPFNHAPPGPPPPVHGQKRAVIVGVSYKNTKDELKGCINDANCMKFMLMKRFQFPESCILMLTEEEADPMRWPTKNNITMAMHWLVLSCKPGDSLVFHFSGHGNNQMDDNGDEVDGFDETLLPVDHRTSGVIVDDEINATIVRPLPYGVKLHAIVDACHSGTVMDLPYLCRMDRLGNYEWEDHRPKTGMWKGTSGGEVFSFTGCDDDQTSADTPQLSGSAWTGAMTYAFIQAIERGHGMTYGSLLNAMRSTVHEIFDKNKGRELVEVGGADFLSTLLGLLILGASPPDEEEEVNQAPQKTQEPQLSANEAFAVYEKPFSL

SEQ ID NO: 23569 - protein, 403 aa, Arabidopsis thaliana
MAKRALLIGINYPGTTEELQGCVNDVHRMHKCLVDRFGFAEEDITVLIDTDESYTQPTGKNIRQALSELIKPAKSGDVLFVHYSGHGTRVPPETGEEDDTGFDECIVPSDLNPIPDDDFRDLVEQVPEGCQITIVSDSCHSGGLIDEAKEQIGESTTTKPNRESKVSSFEFEFKNCLHSIFVKLLAFCGIGSSHVETREIVEVGEGDEVVRSRYLPLERFIELLKQQTGQDNIEIGKIRPTLFDVFGEDSSPKIKKFMKVILTKLRKTNDQSTLLGKIEESARGYIEETLNDEHYMKPAMQAHVKSDREIYGGRSSNGLFPDRGILLSGCQTDETSADVKKKGEAFGAFSNAIQMVLSETDHKDKITNKEMVLRAREILKKQMFIQRPGLYCNDRFVNAPFIC

SEQ ID NO: 23570 - protein, 288 aa, Oryza sativa (japonica cultivar-group)
MVEDPSTDETISWNDSGTAFVVWRPAEFARDLLPKHFKHSNFSSFVRQLNTYGFKKVVADRWEFANDCFRRGEKHLLGGIQRRKGSGTGGAGAAPAGGIPTAIPISSPPTSSGGEPAVSSSPPRGAAGIAAGVSGAVAELEEENARLRRENARLARELARARRVCDGVRRLVSRYDHDHGGGEEEAGEGDVKPMLFGVAIGGKRSREENGEDEEEEEEEGADEDGEDDEVEEDDEERERHAARRVPVREGKVRRTTELSDLDVLALSVRAAAAARPGGASRDRKSSVS

SEQ ID NO: 23571 - protein, 1052 aa, Oryza sativa (japonica cultivar-group)
MDSAALLEVYRRDRRALLGFILSSAGGRAVDLSRVDLDAVSADYALGCVASGVQFDASEATRRYFDERRYPIMMGSPSVNSYFLLSRPERSGSPPNKAAPDIVPQAPAEENPTPIREHVDFFRAAINILGTDNGTKDVSLADIYPKQVNKMDILSLGLPKLSTELSDDDIRETAYEVLLASLFVSGKILFSEEKKEKKPKFLKGLRSKTEVSNPSPQPENHYSQLLDLIRVQMEARQMFSKNYFSSQDRVSMDWVVSVPDGPVEVLTIIERYNAKLCEAPKKFNLKGETYHWIQSYHLNFRLYEKLLCIVFDILEDGQLVEEADEILETVKLTWTILGITQKLHDTLFAWVLFKKFAETGEILLLKHTCLQTQKLRLHNDAKEIELYTNSFVCSAEACGGNMALSLVDSAILKINKWCFRQLENYHSYFNKVDNSIFEGMLNLVVISETSRTDDDDDDEKAMLIGTPLDATQESKLIHILVVRSIQAAYKHELFLERMDNSESLKEILAATNNFELCVAKKLYLMNEGAVGSLLSKYLKPYMISQFSSPLILQWLHVQHENVLEWTKRTIEIEDWEPLSAHERHATSVVEVFRIVEETIEQFFNSSLPLDTVHLRSLLIGITSSLQVYLHHMENQQGLTMDVKSGIISQQVNQVSNLLVGIDSIVPRATLLPSAPVLTRYAESVNPFAKRKLIVPTVPEEKVANKLNNLTVPKLCAKLNTLQFIRDQLDNIEEGIKQSWVSVQSAVGLLDYLSCIASGRTLPKNLSSEESIDELFTIFDDVRRTALYIHHWKSKGTRAVFWDMRDSLLFSLYRASVESARMEMFIPTIDQVLDQVCDLIVDALRDQVVLRVFQACMEGLIWILLDGGPSRAFLETDVDLMHQDLAMIKDLFIAEGQGLPLDLVEKEARLTHQILDLFVLKKEKFCSSQLNENDFQADTIIDMLINQYYMVVPNGCRDENYDDISTKNAPSKAPMFSDMLKSTSFNCYISRMVLTSQKVGIESNKHTFLLMPLRAHSLWESSGPDRNEANQYPNLAVKGVVIILYGTMDLLYA

SEQ ID NO: 23572 - protein, 516 aa, Oryza sativa (japonica cultivar-group)
MAKPAPAPAAGAREDEDAPALRRRLRRLVAAATAGAASESVLDEAAAALAALRDAEVGVGRKGVGGGEEAAAAAVPALFLCPISSGIMRDPVVIESGQCEVWILYIILASQFHAIGVFSVTTCLYEYRGEFLLFKYADMMRFSRNMEQNSKSTNMTYDRRSIQEWFSAGNQICPQTQQVLSHTIVIPNHLVRTMISQWCTENGLTLPEIENQEQDHVTNSEEKTFDEIFVKITSSANSGGRKQAIKDLRLLTKRNSEFRAVLGQRPDSIAQMILARSTPGLQNDPQVLEDMVTIILNFSIHDSNKKIIGDDSEAIQFLIWALKSGDMGSRSNSAAAIFTLSALDSNKEKIGKLGAMDPLIDLLEHGSIIAKKDAASAIFNLCLLHENRSIAARSGIVDVAMRAIDDQSLVEESLAILALLSRNQEMVEIITEFNGTASMLRSIRESECKRSKENAMVVLFAICTYNRTKLKEVEADESINGSLTFLAQTGTQRARRKASGILEKMKRTMHNRHCSC

SEQ ID NO: 23573 - protein, 301 aa, Oryza sativa (japonica cultivar-group)
MAGGRPLESVLVAPGVKGKKVLAFKRDGLKKNEAVTGLIHDIVASSSARSAFHVLDLAKVVDLYAGWRRALPGVRPFYAVKCNPDTALLGALAALGAGFDCASRAEIEAVLALGVPPAAIVYANPCKPGAHVAFAAEAGVNVTTYDSEEEVAKVKRCHPSCELLLRIKAPDCGGVKPGRYFAETAFTLAARVIGKRRRGDVREYWIDDGVYGSLNCILLDSYVPRPRPLAGARPGEETHASTVFGPTCDSIDTVVTGYQLPEMSVDDWLVFDDMGAYTTAAGSSFNGFATSAINTYLAYSS

SEQ ID NO: 23574 - protein, 278 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 23575 - protein, 94 aa, Mimulus guttatus
RNGLFKKAHELTVLCDAKVSILMISSTQKLHEYISPSITTKQMFDQYQKAVGVDVWNTHYERMQEHLKKLKDVNRNLRTEIRQRIGESLNDLGY

SEQ ID NO: 23576 - protein, 106 aa, Mimulus guttatus
QTNRQVTYSKRRNGLFKKAHELTVLCDAKVSILMISSTQKLHEYISPSITTKQMFDQYQKAVGVDVWNTHYERMQEHLKKLKDVNRNLRTEIRQRIGESLNDLGYE

SEQ ID NO: 23577 - protein, 105 aa, Mimulus guttatus
QTNRQVTYSKRRNGLFKKAHELTVLCDAKVSILMISSTQKLHEYISPSITTKQMFDQYQKAVGVDVWNTHYERMQEHLKKLKDVNRNLRTEIRQRIGESLNDLGY

SEQ ID NO: 23578 - protein, 96 aa, Mimulus guttatus
KRRNGLFKKAHELTVLCDAKVSILMISSTQKLHEYISPSITTKQMFDQYQKAVGVDVWNTHYERMQEHLKKLKDVNRNLRTEIRQRIGESLNDLGY

SEQ ID NO: 23579 - protein, 93 aa, Mimulus guttatus
NGLFKKAHELTVLCDAKVSILMISSTQKLHEYISPSITTKQMFDQYQKAVGVDVWNTHYERMQEHLKKLKDVNRNLRTEIRQRIGESLNDLGY

SEQ ID NO: 23580 - protein, 91 aa, Mimulus guttatus
NGLFKKAHELTVLCDAKVSILMISSTQKLHEYISPSITTKQMFDQYQKAVGVDVWNTHYERMQEHLKKLKDVNRNLRTEIRQRIGESLNDL

SEQ ID NO: 23581 - protein, 105 aa, Mimulus guttatus
QTNRQVTYSKRRNGLFEKAHELTVLCDAKVSILMISSTQKLHEYISPSITTKQMFDQYQKAVGVDVWNTHYERMQEHLKKLKDVNRNLRTEIRQRIGESLNDLGY

SEQ ID NO: 23582 - protein, 87 aa, Mimulus guttatus
RNGLFKKAHELTVLCDAKVSILMISSTQKLHEYISPSITTKQMFDQYQKAVGVDVWNTHYERMQEHLKKLKDVNRNLRTEIRQRIGE

SEQ ID NO: 23583 - protein, 93 aa, Mimulus guttatus
RNGLFKKAHELTVLCDAKVSILMISSTQKLHEYISPSITTKQMFDQYQKAVGVDVWNTHYERMQEHLKKLKDVNRNLRTEIRQRIGESLNDLG

SEQ ID NO: 23584 - protein, 99 aa, Mimulus guttatus
TYSKRRNGLFKKAHELTVLCDAKVSILMISSTQKLHEYISPSITTKQMFDQYQKAVGVDVWNTHYERMQEHLKKLKDVNRNLRTEIRQRIGESLNDLGY

SEQ ID NO: 23585 - protein, 106 aa, Mimulus nasutus
QTNRQVTYSKRRNGLFKKAHELTVLCDAKVSILMISSTQKLHEYISPSITTKQMFDQCQKAVGVDVWNTHYERMQEHLKKLKDVNRNLRTEIRQRIGESLNDLGYE

SEQ ID NO: 23586 - protein, 94 aa, Mimulus nasutus
RNGLFKKAHELTVLCDAKVSILMISRTQKLHEYISPSITTKQMFDQYQKAVGVDVWNTHYERMQEHLKKLKDVNRNLRTEIRQRIGESLNDLGY

SEQ ID NO: 23587 - protein, 92 aa, Mimulus nasutus
GLFKKAHELTVLCDAKVSILMISSTQKLHEYISPSITTKQMFDQYQKAVGVDVWNTHYERMQEHLKKLKDVNRNLRTEIRQRIGESLNDLGY

SEQ ID NO: 23588 - protein, 82 aa, Mimulus nasutus
TVLCDAKVSILMISSTQKLHEYISPSITTKQMFDQYQKAVGVDVWNTHYERMQEHLKKLKDVNRNLRTEIRQRIGESLNDLG

SEQ ID NO: 23589 - protein, 87 aa, Mimulus nasutus
HELTVLCDAKVSILMISSTQKLHEYISPSITTKQMFDQYQKAVGVDVWNTHYERMQEHLKKLKDVNRNLRTEIRQRIGESLNDLGYE

SEQ ID NO: 23590 - protein, 345 aa, Homo sapiens
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 23591 - protein, 362 aa, Homo sapiens
MAAAEEEPKPKKLKVEAPQALRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 23592 - protein, 283 aa, Microtetraspora sp. ATCC 39727
MSQTPPPQNQPYPGHTGEMAPEPRDEMRDYVGRALLDGKKALITGGDSGIGRAVAVAFAKEGADVAIAYLTEHEDAAHTRKLVEQAGRRCVLLPGDLADRAHCSSVVEQAVSELGGLDVLVNNVAYQAPVSGLEELDDEQWEHTFAVNIHSYYRVTKAALAHLREGAAIVNTSSINGLRGNKSLIDYAATKGAINAFTYSMAQNLVERGIRVNAVAPGPVWTPLIPATMPEEKVEKFGKQVPMGRAADPDEIAPSYVFFASNRLSSYYTGEVLAPIGGRDAAG

SEQ ID NO: 23593 - protein, 423 aa, Oryza sativa (japonica cultivar-group)
MVGGELVLAALVILLALLLTLVLSHFLPLLLNPKAPKGSFGWPLLGETLRFLSPHASNTLGSFLEDHCSRYGRVFKSHLFCTPTIVSCDQELNHFILQNEERLFQCSYPRPIHGILGKSSMLVVLGEDHKRLRNLALALVTSTKLKPSYLGDIEKIALHIVGSWHGKSKDKGMVNVIAFCEEARKARARISSTVKGIIEERRNAGSSNKGDFLDVLLSSNELSDEEKVSFVLDSLLGGYETTSLLISMVVYFLGQSAQDLELVKREHEGIRSKKEKDEFLSSEDYKKMEYTQHVINEALRCGNIVKFVHRKALKDVRYKEYLIPSGWKVLPVFSAVHLNPLLHGNAQQFQPCRWEGASQGTSKKFTPFGGGPRLCPGSELAKVEAAFFLHHLVLNYRWRIDGDDIPMAYPYVEFQRGLQLQPR

SEQ ID NO: 23594 - protein, 350 aa, Oryza sativa (japonica cultivar-group)
MEQGGEAGTGGGLGNLRALLAILQWWGFNVTVIIINKWIFQKLDFKFPLTVSCVHFICSSIGAYIAIHVLKAKPLIQVEPEDRWRRIFPMSFVFCINIVLGNVSLRYIPVSFMQTIKSFTPATTVILQWLVWSKHFEWRIWASLVPIVGGILLTSITELSFNMFGFCAAMVGCLATSTKTILAESLLHGYKFDSINTVYYMAPFATMILALPAVLLEGGGVVTWFYTHDSIASALVIIIGSGVLAFCLNFSIFYVIHSTTAVTFNVAGNLKVAVAVLVSWLIFRNPISPMNAIGCAITLVGCTFYGYVRHLIPQQQAVAPGTGSPTTSQTNSPRSRMEMLPLVGDKQEKV

SEQ ID NO: 23595 - protein, 391 aa, Oryza sativa (japonica cultivar-group)
MLPSHLNGHSPLARRCPRLSAASPPATGDSDAAAAAADAPLAEHDRIYFQSYSHIGIHEAMIKDRVRTDAYRSAIMHHQKFIEGKVVMDVGCGTGILSVFCARAGAKCVYAVEASEMATQAREIVKANNLDDKVVVVHGRVEDVEVEDKVDVIISEWMGYMLLYESMLPSVLFARDKWLKPGGLILPSHATLFMAPITNSERYEGSVDFWSDVYGINMSALVPLAKKFTSEEPSIEIIGGENVLSWPFVVKHIDCYTFKAEELKSFTTKYKVSSMMLAPIHGFGLWFEVEFNGPSNPTDKSPSDLNPLDVIRKKRRRGSEDPVVLSTAPEDEPTHWHQTILYFPDPIEVKQDQIIEGSVKVSQSEENPRFLNIQLDCTTGGQTLVKDYAMR

SEQ ID NO: 23596 - protein, 572 aa, Oryza sativa (japonica cultivar-group)
MGNACGGSLRSKYLSFKQTASQRHDTDDNNNAAAADSPKKPSRPPAAAKTDDHPVSASAPAAAMRRGQAPADLGSVLGHPTPNLRDLYAMGRKLGQGQFGTTYLCTELSTGVDYACKSISKRKLITKEDIEDVRREIQIMHHLSGHKNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQTFTDVVGSPYYVAPEVLLKHYGPEADVWTAGVILYILLSGVPPFWAETQQGIFDAVLKGFIDFDSDPWPVISESAKDLITKMLNPRPKERLTAHEVLCHPWIRDHGVAPDRPLDPAVLSRIKQFSAMNKLKKMALRVIAESLSEEEIAGLKEMFQTMDADNSGAITYDELKEGLRKYGSTLKDTEIRDLMDAADNFSLMIVFLLQTFQKQVNMADIDNSGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAL

SEQ ID NO: 23597 - protein, 175 aa, Oryza sativa (japonica cultivar-group)
MASSSSAQETGRWSLAGATALVTGGSKGIGRAIVEELASFGATVHTCARNEATLNSCLEEWSAKKLSITSSVCDVSARADREALAGRVTAMFDGKLDILVNNVGFLFLKPAVNVTPEELSRVMAGNLESCFHLSQLMHPLLKTSGKGNVVNISGISTVTGFPSLPICAFCAAKGS

SEQ ID NO: 23598 - protein, 713 aa, Oryza sativa (japonica cultivar-group)
MVDINPDHIFEVPDTPDRIQQSTCPVSSPAARRGIAKAAGTPLPSRRIKFKITNNSIQGQSSRGNASSVSPAPLDAGDIFKQAELARLLPVAEDPEARSSLLKSGRTIETSVENEKVPKKSGLDQSMNISNNINCRGSGERDRSCQIRKGDISARDANSCNADFLCLGSGLPTTTVGKPRNRMGTITFKKPKEVVGANVCSVSSPREGKGEEITDKGTTGISSSTPSIVPQRHVGQRKLVRNGCISPSNIAKRSLKVDEKREICSTSGLLHYPDTQVDASGKGNVIDLTDSSPIIRRQGNTATDMEKRSGRKSAIGRAGETVIPLAANQVNSIFSEGNKNKGKEISHDVVGAKQSGEAYMRRVCPRSMGDSSSVANNDHTGIGSEQGKMTNSCGRESGSSEQSNLDRASAAGDSNNSIEGGDNNNSIGGAKTLQTASFVNRTIRISSRKRKRIASSYHPGESSSSVDVDQPRVASSDSTAARNHTTHRHHIPVVDIDDICSPEVRPSLSGIGSSNRTSVDPNIREQLESDELLARQLQEQLYNETPHVVPTEEIDAIIAMSLQHEDNAQPTSRTARRFQSTTRGPRVLRSTVPQHANRVRYDSNNRRIIYQRALSRYPAAHIQPNIDLNDYDALLALDENNHQHAGASESQINNLPQSVIQSNIEEPCAVCLDNPSIGDTIRRLPCFHMFHKECIDEWLRRKKLCPVCKSGIT

SEQ ID NO: 23599 - protein, 212 aa, Oryza sativa (japonica cultivar-group)
MGFPVCCYSELLLPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSNCRHVFHRGCLDRWMEHDDQRTCPLCRAPLIPDEMASALWAAAGVPDASDFDFSYFGAPLTPMPTPTLLRPHELLLTGLGGYQ

SEQ ID NO: 23600 - protein, 309 aa, Oryza sativa (japonica cultivar-group)
MEGAGAARKRSRPDTANGGAAGGKRSRETESFQTGLSSKLKPCTKFFSTIGCPFGEGCHFSHFVPGGYQAVAKTLNLGNPAVPAPARAPMDHAAGGNSHPASSGKTRMCTKYNTAEGCKFGDKCHFAHGERELGKPAYMSHESAMAPPMGGRYGGRPEPPPPAAMGPPAGNFGASATAKISVDASLAGGIIGKGGVNTKQICRVTGVKLSIRDHESDSNLKNIELEGNFDQIKQASNMVGELIATISPSTPAKKPAGSAAGAAPAGRGGPGGRSNYKTKLCENFVKGTCTFGDRCHFAHGENEQRKGAA

SEQ ID NO: 23601 - protein, 350 aa, Oryza sativa (japonica cultivar-group); identical to SEQ ID NO: 1132

SEQ ID NO: 23602 - protein, 222 aa, Oryza sativa (japonica cultivar-group)
MAPRNAAEAVAVAVAEGGGAGMEPRFRGVRKRPWGRYAAEIRDPARKARVWLGTFDTAEAAARAYDSAALHFRGPKAKTNFPVAFAHAHHHAPPPPLPKAAALAVVSPTSSTVESSSRDTPAAAPVAAAAKAQVPASPSLDLSLGMSAMVAAQPFLFLDPRVAVTVAVAAPVPRRPAVVSVKKEVARLDEQSDTGSSSSVVDASPAVGVGLDLNLPPPIEEA

SEQ ID NO: 23603 - protein, 274 aa, Oryza sativa (japonica cultivar-group)
MSRLMAAMLLGGARVAGNTTTAVMALHHPRPSYFLPPRPRLAAASWSRLRLQTAPRSSQAYDNSPADDRRDVGDRYRDAAEEAKEATGDAKERVKGMAGEAKGRAADIAGRAKDETKDTASRAADAASRATDRAKHEAADKAADVKDRAKDAADMAQGTARAVRDKTAETAEGAMDRAGEAKDRTVEGTKHAGEKVAEMTKEGASKVVETAQAIGEKAKQAAQGAWGATKEAAQGVKDTVAGGDVDADAAMKEQDRIAQEEKKRQAREKGAGLP

SEQ ID NO: 23604 - protein, 176 aa, Oryza sativa (japonica cultivar-group)
MATSSAYPPPPPYYRLYKDYEKDPSSAPEPPPPVDGPYQLFGATYTTDVVLPSLEDQGVRQLYPKSPDIDFKKELRTLNRELQLHILELADILVERPSQYARRVEDISLIFKNLHHLLNSLRPHQARATLIHMLENQIQRRKQAIEDIKQRREEAQKLLGESLLILDGNQPSLPAM

SEQ ID NO: 23605 - protein, 459 aa, Oryza sativa (japonica cultivar-group)
MVSYVGPSTARPTSGRAWAGYSDDAAAVRESRVASGGIEHGGGRPWPQDQRWYQHCHLQQEEEPWRCQIKAHTVLQGSDALSSIREWSRSHLVTMTGLVACAVLVVPSADAVDALKTCTCLLKECRIELAKCIANPSCAANVACLNTCNNRPDETECQIKCGDLFENTVVDEFNECAVSRKKCVPQKSDVGEFPVPDPSALVKNFNMADFNGKWYISSGLNPTFDTFDCQLHEFRVEGDKLIANLTWRIRTPDSGFFTRTAIQRFVQDPAQPAILYNHDNEFLHYQDDWYIISSKVENKEDDYIFVYYRGRNDAWDGYGGAVLYTRSKVVPESIVPELERAAKSVGRDFSTFIRTDNTCGPEPPLVERIEKTVEQGEKTIIREVQEIEGEIEGEVKELEEEEVTLFKRLTDGLMEVKQDLMNFFQGLSKEEMELLDQMNMEATEVEKVFSRALPIRKLR

SEQ ID NO: 23606 - protein, 318 aa, Oryza sativa (japonica cultivar-group)
MATSATAGAAAAVASPAVAPRGAAVAAVARRGFVSFGAAAAARSRAVRSGGFSGVQTHVAAVEQALVQDATKLEAPVVIVTGASRGIGKATALALGKAGCKVLVNYARSSKEAEEVSKEIEACGGQAITFGGDVSKEADVDSMMKAALDKWGTIDVLVNNAGITRDTLLMRMKKSQWQDVIDLNLTGVFLCTQAATKIMMKKKKGKIINIASVVGLVGNIGQANYSAAKAGVIGLTKTVAREYASRNINVNAIAPGFIASDMTAELGEDLEKKILSTIPLGRYGKPEEVAGLVEFLALNPAANYITGQVLTIDGGMVM

SEQ ID NO: 23607 - protein, 514 aa, Oryza sativa (japonica cultivar-group)
MPPCVWGSHTPLSLLSPPAAWAGERMEGDQAGGDLTDIVRAGGGAMPGSVVVDLPSTAAEWQLPAEPMLFPPPPSLSSTTDGCGAGGAAGADIFGGGGGDLFSGLVDPFSSDYSSGADFLDAMPDAMAKVGFDTAVGGGCGGGGGGGGGSGGHLLDMSRKPLLPRGMPMAAVGGLAAPRVMPSPLSPRAIRPYPPISAGDMMKLGITAGQAAGCAIDAAVAGMQMSSPRSGGIKRRKNQARKVVCIPAPTAAGGRPSGEVVPSDLWAWRKYGQKPIKGSPYPRGYYRCSSSKGCSARKQVERSRTDPNMLVITYTSEHNHPWPTQRNALAGSTRSHHSKNSGGGGGSGSKGSQNDKSQQQPSVKEEQKDQATTATTTTTSTITTTNSASPVVVKEEEAALAGSSEALELERVMDTTAAGVVDHSELMDHVFSESYKPMIPETGQPDDFFADLAELESDPMSLIFSKEYMEAKPSGGDHAQEKAMAKELDPFDMLDWSTTTNSSAGSSFEQGKRG

SEQ ID NO: 23608 - protein, 389 aa, Oryza sativa (japonica cultivar-group)
MDPNDAFSAAHPFRWDLGPPAPAPVPPPPPPPPPPPPANVPRELEELVAGYGVRMSTVARISELGFTASTLLAMTERELDDMMAALAGLFRWDLLLGERFGLRAALRAERGRLMSLGGRHHGHQSGSTVDGASQEVLSDEHDMAGSGGMGDDDNGRRMVTGKKQAKKGSAARKGKKARRKKVDDLRLDMQEDEMDCCDEDGGGGSESTESSAGGGGGERQREHPFVVTEPGEVARAKKNGLDYLFHLYEQCRLFLLQVQSMAKLHGHKSPTKVTNQVFRYAKKVGASYINKPKMRHYVHCYALHCLDEEASDALRRAYKAPGENVGAWRQACYAPLVDISARHGFDIDAVFAAHPRLAIWYVPTRLRQLCHQARSSHAAAAAALPPPLF

SEQ ID NO: 23609 - protein, 798 aa, Oryza sativa (japonica cultivar-group)
MASKLSFKRMDSIAETMPDALRQSRYQMKRCFQRYVSKGKRLLKNQQLMEELEKSLDDKVENEKLVEGFLGYIICSTQEAVVLPPFVAFAVRMNPGIWEYVKVHSDDLSVEGITPSEYLKFKETLYDEKWAKDDNSLEVDFGALDLSTPHLTLPSSIGNGLQFVSKFMSSKLGGKPESMKPLLDYLLTLNYRGEKLMINDTIDTVSKLQTALLLAEVFVSGLPKYTPYLKFEQRFQEWGLEKGWGDTAERCKETLNCLSEVLQAPDPTNMEKFFSRVPSIFNIVIFSIHGYFGQEKVLGLPDTGGQVVYILDQVRAMEEELLQRIKQQGLHVTPKILVLTRLIPDAKGTKCNVELEPVENTKYSHILRVPFKTEDGKDLRQWVSRFDIYPYLERYAQNSCAKILDILEGKPDLIIGNYTDGNLVASLLSNKLCVTQGTIAHALEKTKYEDSDVKWREMDQKYHFSCQFTADMISMNTSDFIITSTYQEIAGSKEKPGQYEHHYAFTMPGLCRYATGINVFDPKFNIAAPGADQSIYFPFTQKQKRLTDLHPQIDELLYSKDDTDEHIGYLADRNKPIIFSMARLDKVKNITGLVEWYGQNKKLRDLVNLVVVAGLLDASQSKDREEIEEINKMHNLMDRYQLKGQIRWIKAQTDRVRNGELYRCIADTKGAFVQPALYEAFGLTVIEAMNCGLPTFATNQGGPAEIIIDGVSGFHVNPINGREAGIKIADFFQKCKEDPSYWNKVSTAGLQRIYEWQRLWQEQGINRLGKPQQAWRLKAADSDAKDLNQVSRAEASSF

SEQ ID NO: 23610 - protein, 206 aa, Oryza sativa (japonica cultivar-group); identical to SEQ ID NO: 3893

SEQ ID NO: 23611 - protein, 177 aa, Oryza sativa (japonica cultivar-group)
MQVNNVGFFFLKPAVNVTPEELSSVMAGNLESCFHLSQLVHPLLKASGKGNIVNISGISTVTGFPTLPICVFSTAKGAMNQITKSLAVEWASDKIRVNCIAPGIIDTPLGDDVKSGNNPHLQGVSGTDFIQDDIARTPMRRVGKPEEVSSLVAFLCMPAAAYITGQIICVDGGRTLS

SEQ ID NO: 23612 - protein, 268 aa, Oryza sativa (japonica cultivar-group)
MVTALAHVIRAAPDLHLPHHPSSSASAAAHPQQASSFYPTAAAAASSPSDQLAAAAAAEEQGRRRHYRGVRQRPWGKWAAEIRDPKKAARVWLGTFDTAEDAAIAYDEAALRFKGTKAKLNFPERVQGRTDLGFLVTRGIPPAATHGGGYYPSSSPAAGACPPPRQQQTVVPYPDLMRYAQLLQGGVGGSYMPFGGAATMSSSTVSSSSAPQILDFSTQQLIRAGPPSPMPSSGSGSATAAASSTTSASSPGAWPYGGSERKKKDSSS

SEQ ID NO: 23613 - protein, 424 aa, Oryza sativa (japonica cultivar-group)
MATFKEHLQERSAHSIGRVNAHGYEDSNFLLTKLTENKMSCPMTISMLAPTLGTVGRINEESRTRRNAGYPINFEFDFGPVIEFLNMRLNNAGDPFMECNYGIHSKKFEIAVLDWFARLWELPKDQYWGYVTSGGTEGNMHGLLVGRELFPEGIIYTSCDSHYSIFKAAKMYRVQCIKIDTLFSGTTMKGAVDDLDEVVMILENCGFANRFYIHCDSALVGLMMPFIKQVNPKAPKLTFKKPIGSICISGHKFIGCPIPCGVLITRLMDINHVMSTNIEYISSNDTTIAGSRNGHAPIFLWYALKRIGYNGLCKTVENCLKNAQYLALRLREMGVSVFLNALSITVVFERPNDETFVRKWQLACQGKIAHVVVMPNVSLERINMFLEEFTKSRIALHQDKCVAGDVSQENCLCSLHLDRKKEAV

SEQ ID NO: 23614 - protein, 247 aa, Oryza sativa (japonica cultivar-group)
MMERAEDLRLSLSLSSPLIAPRTHHVAMLFHAPPEKRFLEMPLLPAAKRSEVVAAEEERAGLRGGGGSDEEDGGCGIDGSRKKLRLSKDQSAVLEDSFREHPTLNPRQKATLAQQLGLRPRQVEVWFQNRRARTKLKQTEVDCEFLKRCCETLTEENRRLQKEVQELRALKLVSPHLYMNMSPPTTLTMCPSCERVSNTNNNSSAAAAADRRGIRTTTAAGGGSVVDTAADGGILCHRPIAVRPQQS

SEQ ID NO: 23615 - protein, 344 aa, Oryza sativa (japonica cultivar-group); identical to SEQ ID NO: 3769

SEQ ID NO: 23616 - protein, 229 aa, Oryza sativa (japonica cultivar-group)
  unsure (1)..(229): unsure at all Xaa locations
MADEYGRGGYGRSGAGAGDDYESGGYNRSSSGGADEYAAGRSGRAQKPVXDASKRFTKSRRRATTYGXRRRRVNKSGPRASDSGXNNRSGANRSTAATSPARRVQRRXGAEADEEYVDGLSSRAPGEVQEGGEGAQEQGAPREVGPXRRXFAMYERHQAKKDPENAQRHRIEEGVAAAAALGSGGFAFHEHHDKKEAKQAAKDAEEEAEEESGSGARGGEGKKKHHLFG

SEQ ID NO: 23617 - protein, 281 aa, Wigglesworthia glossinidia endosymbiont of Glossina brevipalpis
MKKINILTCVNQSSLESYIKKANSYSMLSIEEEKILTERLHYNGDLLAAKKLILSHLRFVVHISRNYSGYGLQRADLIQEGNVGLMKAVKRFNPAIGVRLVSFAVHWIKAEIHEYVLRNWRIVKVATTKAQRKLFFNLRKAKKKLGWFNQYEVDMLAKSLGVTSKDVREMESRMSAKDMAFDFNSEEDKHKNNAILYLKDKTSDFADTIEEDNWDIHATDKLSAALSNLDLRSQEIIRSRWLRYDNKSTLKELAKKYGISAERIRQLEKNAMKKIRFAVES

SEQ ID NO: 23618 - protein, 244 aa, Wigglesworthia glossinidia endosymbiont of Glossina brevipalpis
MNFNKKISLVTGANRGIGKSIAKELLKRNSIVIGTSTSKEGVDIINNYVKKQGKGIVLNLLDKNSIKLCIEKIKKNFGDVDILINNAGTNKDELLIRMKENSLNHVININLISVFIISKIVIKGMIKKRYGRIINIGSVSGFTGNIGQTNYSASKSGLTGFTKSLAREVAKKGITVNMVSPGFIKTDMTKSLSENNKKNILSNIPVNRFGSTKDVANAVIFFASDLSSYITGETMHVNGGIYMK

SEQ ID NO: 23619 - protein, 151 aa, Wigglesworthia glossinidia endosymbiont of Glossina brevipalpis
MYHALYLANKAKKFGEIPIGSVVILKDNIIGEGWNQSIKKNDPSAHAEILALRSAGKNINNYRLLNTEIYTTIEPCIMCIGAIINARVSRLIFGARKTKKINFFTKDLLNNCNLNHKISLTEGILEENCKKIINKFFSKIRKKNKNKFLCF

SEQ ID NO: 23620 - protein, 626 aa, Wigglesworthia glossinidia endosymbiont of Glossina brevipalpis
MNNSKNKNEIKFSILKKINNPIELRKLPKKKLIFLCEELREFLIDSVSSSSGHFASGLGVIELTVALHYIYNTPFDYLVWDVGHQAYPHKIITGRRDQIRSIRKKNGLHPFPFREESEYDILSVGHSSTSISASLGMSISARKEGMGRKVVSVIGDGAITSGMAFEAMNHAGDIKSDLLIVLNDNEMSISENVGALNKYSNNFISKKIFPFLKKNGEKLLNKIPRFKKIIEILENKINNYFSPKYLFEELGFNYSGPYNGHDVLLLSNILKKLRLKKGPNILHVITKKGMGYAPAEKDPIGWHAVPKFNLQIGIPPKKQNSLNTYSSIFGKWLCDTAKKDKKLIAITPAMREGSGLVNFSKMYPNQYFDVAIAEQHAVTFAAGLAIGGYKPIVAIYSTFLQRAYDQIIHDIAIQKLPVLFAIDRAGIVGPDGPTHQGFLDLSYLRCIPNMIIMTPSDENECRLMLHTGYQQLGPSAVRYPRGYGIGVKFSNLYKIPLGKGIVLRKGKKIAILNFGVLLIQANIVAKELDATLVDMRFVKPLDNLLLIRMAKTHKALITIEENVIMGGAGSAVNEFIMYNKLLVPVLNIGIPDNFVSHGSQTEVRSSLGLDSIGIKEKIKNWLNFLV

SEQ ID NO: 23621 - protein, 443 aa, Wigglesworthia glossinidia endosymbiont of Glossina brevipalpis [sequence omitted]

SEQ ID NO: 23622 - protein, 397 aa, Wigglesworthia glossinidia endosymbiont of Glossina brevipalpis
MKKITILGSTGSIGKNTLKIISNNLDKFSVYSLVAYGNNINVLISQCIKYKPNYVCIMNKKKLLDLKQGLLKNKCKTSVLFGSNDICNLSSSKEVDIVISATVGLSGIFFLFSAIKSGKKILLANKEILVSCGHFFMKQVEKYKSIIIPIDSEHNAIFQSLPLDFQKKLGIASINKYGIYKLILTGSGGPFRNVELRDLKKVSPDQACNHPNWKMGKKISIDSATMMNKGFEYIVAKWLFNVCKDQIELIIHHQSIIHSMIRYIDGTVIANMSLPDMQSSISYGLGYPKRIKIKNKYLDFYKNNKLTFESIDYNRYPCLNLAIQASYNGQGATTVLNSANEISVSAFLSKKIYFTDIAIINKKVLDKLDIFEPSSIEEILLLDSKARNLAKKFIKCY

SEQ ID NO: 23623 - protein, 404 aa, Wigglesworthia glossinidia endosymbiont of Glossina brevipalpis
MKELFNKNILLGISGSIAAYKSLELIQQLKKKGAIVRVVMTKSAQAFVTPLSLKIISGHQVFIDSDFLYNKMIDHIKISKWPDIIVLAPATANLLAKLSSGITNDLLSAICLATSSPIAISPVMNKNMYLAPSTQDNLKKLNNRGVIFWGPDYGNQICGDKGFGRMIKISKLVKLITNYFKSGFNNVKNLKIMVTAGPTIELIDPVRFISNYSSGKMGFAIVKAAIDVGYQVTLISGPVKISTPDGIFKKINIKSAIEMKDAVMSLVKNQDIFICCAAITDYRLEKISRKKIKKQKNNKLCLKLVKNPDIISEVASLKKNRPYIVGFSADTEKIGKYAKEKRIKKNIDLICANDVSKPNQGFNSNYNALHLFWKTGSMMLSINNKLSLAKKLLHQIIIFYEKKS

SEQ ID NO: 23624 - protein, 601 aa, Wigglesworthia glossinidia endosymbiont of Glossina brevipalpis
MEKNQQSQLKLLVTRGKEQGYLTFSEVNDFLPENIIDSHQIEDIIQMINDMGIQVMDEAPNSENLLLPDSNNNSDEDVAEAAAQVLSNVESEFGKTTDPVRMYMREMGSVQLLTREGEIDLAKRIEYGINQIQCAIVEYPKAIIYLLDQYKKTTTGESKLSELITGFVDPNIVVDSSNIDLNTEDISSEEENNTSEEIDIDKELANKRFIELQEQYKISFNTIKEYGRMHEFSIKEIIYLADIFKQFRLVPKQFDYLVFIIRSEIEKIRFYERRIMRICVNICKMPKKFFISLFSGNETNDVWLKKALSLDKPWSRKLYKLNKPICLILNKLKIIEINSGITIEQAKDINKRMSIGEAKAKRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEIGREPTPEELSEKMLIPEDKIRKVLKIAKEPISMETPIGDDEDSHLGDFLEDTSLDLPLDSATSESLRSATHDVLSGLTAREAKVLKMRFGIDMSTDHTLEEVGKQFDVTRERIRQIEAKALRKLRHPSRSEILRSFLDD

SEQ ID NO: 23625 - protein, 328 aa, Wigglesworthia glossinidia endosymbiont of Glossina brevipalpis
MISLREFIFSNNVNKYISKEDLYSLFIIIELTSKIIHNYIILNNITRIKQEKIKKNIHGEHQTKLDLLSNKKFIDMIKTHYNIAGIASEEEAKFISFKQEKYGKYIFLIDPLDGSLSADCNTPVGTIFSLYCRVTPIGVEISEKDFLQPGNKQILSGYILYGSSTILVFTVKSGVHIFTYHPFFSTFFLSKKNFNYPKKNNIYSINEANYNNFSLGIKKYIMSCKSNNNISSRYTGSLVADFHRNLIKGGIYLYPNTKIYKHGKLRLMYECNPIALISSQANGSSSDGNINILDINPKILHQCSPFFVGTKSMVKLVNKFILGYYNHN

SEQ ID NO: 23626 - protein, 487 aa, Wigglesworthia glossinidia endosymbiont of Glossina brevipalpis
MLHIVKKGLTFDDVLLSPSRSNILPKNVDVSTKLTKKIKLKIPILSAAMDTVTESSMAIALAQEGGMGFIHKNMSIKNQIKEIKKVKRYENGMIMNPKCVTPNTSISTIKNITIINGFGSYPVVTENGKLIGIVTRRDALCAKDINQSVCTVMTPKDKLVTVYQGEKQEIVLSKMYDKRVEKALVVDRFFNLIGMITVKDFKKSEKKPYACKDKYGRLRVGAAISLEKNYIERINLLINSGIDVLLIDSSHGHSENILKKIRSIRDAYPDVQIIGGNVATGEGALDLIKSGVDAVKVGIGPGSICTTRIVTGVGVPQLTAISDAVDAIGSKDIPVIADGGIRFSGDIAKAIAAGAKCVMLGSLLAGSKESPGDIELYHGRSFKIYRGMGSVGAMFHGSSERYFQKNNKIDKLVPEGVEGRVPYKGCVKNIIYQQIGGLRSCMGLTGSSNIEDLRTKTTFVQITRAGIQESHVHDVSITKESPNYNLK

SEQ ID NO: 23627 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKNYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYPLK

SEQ ID NO: 23628 - protein, 255 aa, Oryza sativa (japonica cultivar-group)
MGRGKIAIKRIDNTMNRQVTFSKRRGGLMKKARELAILCDADVGLIVFSCTGRLYDFSSSSMKSIIERYQEAGEEHCRLLNPMSEAKFWQREVTTLRQQVQNLHHNNSFYLSANYLNENSAYYFIRINQYEGENEIFFKAHVEIHVSNKRQLLGEEISNFTVRDLQLLQNQVEMSLHSIRNKKGSLVQKENSELRKKFNIAHQRNIELHKKLNSGESTSSEQVTRSSKDPGESSTPRDSRVCIDLELSQKEVEDE

SEQ ID NO: 23629 - protein, 723 aa, Oryza sativa (japonica cultivar-group)
MQKSSAREEEEEEEEVAAAAAATGAAADVSELELLVPRGGASSGAAGSMDRHALGGGGALEIEKTPEAAEDMESEPALAAAREAERVPPWREQVTARGMVAALLIGVVYTVIVMKLSLTTGLIPTLNVSAALLAFLALRGWTHALDRLGIASRPFTRQENTVIQTCAVACYTIGYGGGFGSFLLGLNKKTYELSGASTPGNVPGSYKEPGIGWMTGFLLSTSFVGLLTLLPLRKVLVIDYKLTYPSGTATAVLINGFHTPQGDKNAKKQVRGFLRYFGISFLWSFFQWFYTGGDVCGFLQFPTFGLKAWKHTFFFDFSLTYVGAGMICSHLVNLSLLFGAILSWGIMWPLIGKQKGNWYSAKASESSMSGLFGYKSFICIALLVGDGFYNFVKVIVVTLKSVRERSRRRGLNNRVADADTMAIDDMQRNEVFNRDNIPTWMAYTGYTLLSVIAVVLIPVMFRQVKWYYVIIAYLLAPALGFCNAYGTGLTDMNMGYNYGKIALFIFAAWAGKDDGVVAGLVGCGLVKQLVLISADLMHDFKTGHLTLTSPRSMLVGQVVGTLMGCVVAPLTFFLFYKAFDVGDPNGYWKAPYALIYRNMAIIGVEGFSALPRHCLQLCAGFFAFAVLANLARDFLPRRYGRYMPLPMAMAVPFLVGASFAIDMCAGSLVVFLWHRFDGKRAALLVPAVASGLICGDGIWTFPSSLLALAKVKPPICMKFIPGN

SEQ ID NO: 23630 - protein, 394 aa, Oryza sativa (japonica cultivar-group)
MASGTDEKAKMEGLTSAAAFVEGGIQDACDDACSICLEAFCESDPSTLTGCKHEFHLQCILEWCQRSSQCPMCWQPISLKDPTSQELLEAVERERNVRTNQTRNTTIFHHPALGDFEVQHLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRNSSVADLGSEVRREVNAGIASVSRMMERLETRGSNGRTSDGPAISTSEVIPSTESSNERVTENNPTTAATSTSNTSASSAPCVTTTGSN

SEQ ID NO: 23631 - protein, 625 aa, Danio rerio
MEYHKPDKKTLQALKDIANKLRIHSIRQTCASNSGHPTSCCSAAELMSVLFFHTMRYKADDPRNPCNDRFILSKGHAAPILYAAWAEAGYIKESDLLNLRKIDSDLEGHPTPKLAFVDVATGSLGQGLGAACGMAYTGKYLDKSSYRVYCMLGDGECSEGSVWEAMAFASHYKLDNLVAILDVNRLGQSEPAPLQHNVNVYKERCVAFGFNTYVVDGHDVEELCKYMWEAEGVKGKPTAIVAKTFKGKGLKGIEDQDNWHGKPMPKDRAEELINDLLSQIQSPNKPLYPQPPKEDAPPADLSPIHLLTAPEYKLGDKISTRKAFGVALKRLGDASTRVVALDGDTKNSTFADMFKKAHPDRYIECFIAEQNMVSVAIGCATRERTVSFASTFAAFLARAYDQIRMAAISQSNVNLVGSHCGVSIGEDGPSQMALEDLAMFRAIPTCTVFYPSDGVSTERSVELAANTKGICFIRTSRPDTAVIYNPEEKFEIGKAKVVRQSSKDQVTVIGAGVTLHEALAAHDQLAKEGVNIRVIDPFTIKPLDASTIVASARATGGRVITVEDHYKEGGLGEAVLSAVGEEPGIVVHRLAVSRVPRSGKPQELLDMFGISAKCIVAAVKRTFAN

SEQ ID NO: 23632 - protein, 235 aa, Danio rerio
MATAGKVIKCRAAVAWEPKAPLMMEEIEVAPPQEGEIRIKVIATGLCHTDLYHLVDGDKRGFPVVLGHESAGVVESVGPGVTDYKPGDKVIPLFLSQCGKCKFCKCPKTNLCESSWATKYHDIMAEPTSRFTCRGQTILPYLYTGKQMYCPEKQHLLGQQRLYKQHTCGNNLLLRLVWNLINILSRSQRSRPLMLLLSRNDHQHKGSDSELPRWDKHQLLLHLHRVLWLQGVQLP

SEQ ID NO: 23633 - protein, 381 aa, Pseudomonas aeruginosa
MRVLHFYKTYLSETVGGIEQVIFQLCESSGSWGIDNHFLTLSSDPHPPVVPFGGHVVHRARLDLQLASTGFSLSVFKQFRELAAEADVVNYHFPWPFMDLVHFLTGMNKPSVVTYHSDIIRQRVLLKLYRPLMSRFLHSVDRIVAASPNYFSTSDVLRQYREKTRVITYGLDKDGYPKPATQRLEHWREKLGPRFFLFVGVMRYYKGLHILLDALQGTDYPVVIVGAGPLQAELYAQTAALGLRNVHFLGRVDDEDKVALLQLSYAMVFPSHLRSEAFGISLLEGAMYGKPMISSEIGTGTSYINIHGETGLVVPPSQPAAFRQAMRWLWEHPQQAEEMGRNAEARYRQLFTAEEMGRRWSELYRELLEEKASSRYVKAAR

SEQ ID NO: 23634 - protein, 162 aa, Streptomyces lividans
YATWWIRQAMSRALADQARTIRVPVHVVELINRVVRVQRRMLQERGCEPTPQEVAAHLDLAPERVGEVLRLAQEPVSLHAPVGEEDDVALGDLIEDGDAASPVESAAFLLLRQHLEAVLSTLGERERKVVQLRYGLADGRPRTLEEIGRLFGVTRERIRQIE

SEQ ID NO: 23635 - protein, 161 aa, Micromonospora echinospora
YATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFSLLQDQLQQVLQGSPSVRRVWSMRFGLTDGQPRTLDEIGQVYGVTRERIRQIE

SEQ ID NO: 23636 - protein, 162 aa, Micromonospora olivasterospora
YATWWIRQAITRAMADQARTIRIPVHMVEVINKLGRIQREFFQDLGREPTPEELAKEMDITPEKVLEIQQYAREPISLDQTIGDEGDSSLGDFIEDSEAVVAVDAVSFSLLQDQLQQVLQTLSEREAGVVRLRFGLTDGQPRTLDEIGQVYGVTRERIRQIE

SEQ ID NO: 23637 - protein, 162 aa, Streptomyces glauceuces
YATWWIRQAMSRALADQADTIRVPVHVVELINRVVRVQRRLLQERGVEPTAEDIGVDLDLTPERVTDILRLGQEPVSLHAPVGEEDDVSFGDLIEDGDAASPVESAVFLLLREHLEAVLSTLGERERKVVQLRYGLEDGRPRTLEEIGRIFGVTRERIRQIE

SEQ ID NO: 23638 - protein, 152 aa, Pseudonocardia autotrophica
YATWWIRQAITRAMADQARTIRIPVHMVEVINKLGRIQRELLQDLGREPTPEELAKEMDITPEKVLETQQYAREPISLDQTIGDEGDSQLGDFIEDSEAASPSDAVSFTLLQDQLQSTLGTLSEREAGVVRLRFGLTDGRPRTLDEIGQVYG

SEQ ID NO: 23639 - protein, 161 aa, Streptomyces bluensis
YATWWIRQAITRAMADQARTIRIPVHMVEVINKLARVSRQMLQDLGREPTPEELAKELDMTPEKVIEVQKYGREPISLHTPLGEDGDTQFGDLIEDSEAVVPADAVSFTLLQEQLHSVLDTLSEREAGVVSMRFGLTDGQPKTLDEIGKVYGVTRERIRQI

SEQ ID NO: 23640 - protein, 161 aa, Streptomyces spectabilis
YATWWIRQAMSRAMADQARTIRVPVHVVELINRVVRVQRRMLQERGYEPSPEEVAAHLDLPHERVRGLRLAQEPVSLHAPVGEEDDVALGDLIEDGDAASPVESAAFLLLREHLEAVLSTLGERERKVVQLRYGLADGRPRTLEEIGRIFGVTRERIRQIE

SEQ ID NO: 23641 - protein, 162 aa, Streptomyces peucetius
YATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIDVATVESLKEATRDVLSGLTAREAKVLRMRFGIDMNTDHTLEEVGKQFDVTRERIRQIE

SEQ ID NO: 23642 - protein, 229 aa, Rosa rugosa
MARGKIQIKRIENVTNRQVTYSKRRNGLFKKANELTVLCDAKVSLLMVSSSGKLHEFISPSTTTKQVYDEYQKLLGIDLWKSHYETMQENLKKLKEINKSLRRQISHRVGECLNDLRFAELHSLEKEMESAVEVVRNRKLKLISNQIDTKRKKIRNATECNRRLYEYDAMEEPHYGLVDDGGDYYDSAVIGYSANEDPHNVFPLRLQPSHHPNLHRGGGSSDLTTYSLL

SEQ ID NO: 23643 - protein, 218 aa, Rosa rugosa
NGLLKKAYELSILCDAEVALIIFSNRGKLYEFCSSSSILKTLERYQKCSYGAMEVNEPAKELEQSSYREYLKLKTRCESLQRTQRNLLGEDLGPLNTKELEQLERQLESSLKHVRSTKTQYMLDQLSDLQSKEHMLIEANRDLTMKLDEINSGTQLRQTWERGHAHQTMLYGTQHAQTQGLMFQPLDCNPTLQIGYNAVGSQQMTAATPAPTQPVNGF

SEQ ID NO: 23644 - protein, 214 aa, Oryza sativa (japonica cultivar-group)
MLSLATRLRRVAGKLARCLATCVFATAGMMLGAIAGVIAGFVSEDGLLQGTLIGAISGAFIAMEVVDSLAKIWCYEEYSIATRAHLMLLVFWNLVIDRLTVRTSVFPTLTTVLDSQLNAVPSRHRRAEVSGDLTGRSYPVVMGMRLAAVDQLPVIKLTAAQTDATGACPICLHDFKAGEIARRLPACCHIFHLGCIDNWLLWHALCPMCRRPVN

SEQ ID NO: 23645 - protein, 414 aa, Oryza sativa (japonica cultivar-group)
MVGGSPMQAVLMAPGVKDKKVLAFKRGKGKDADAGVTALIRDIVAGGARSAFHVFDLAKVVDLHRGWRRALPDVRPCYAVKCNPDGAMLAALAALGAGFDCASRAEIEAVLALGVRPATIVYANPCKPEAHLEYAAEVGVNLTTYDSEEEVAKVRRCHPRCELLLRIKAPDSGDAKVDLGLKYGANPDEVLPLLRAAQREGVAVAGVSFHVGSGASRADVYRGAIEAAREAFDAAAALGMPPMRVLDIGGGFMAGRTFDEAAAVINRALERHFGDLPCVEVIGEPGRYFAETAFTLAARVIGKRTRGELREYWIDDGLYGSLNCILMDHYVPRPRPLAAAAAGEDTTAATTHASTVFGPTCDSLDTVVTGYQLPEMSVGDWLVFDDMGAYTTAAGSNFNGFATSAIKIHLAYSS

SEQ ID NO: 23646 - protein, 221 aa, Ralstonia eutropha
MIPMTQKLTFTRFVIAEQHGSKTVDSDLIALLLDVSIACRKIASSIAKGSPLALGGEAAGRDVPGEIQSKTDMATPCFFARSEALARHLAGMASEGMEGAYPVPLRSPQGRYLLVCDPLDGSANIDVNVSGGIIFSVLRCPEGISAPEERDLLQAGSAQMAAGYALYDAPALLVLKTGSGIHGFTLDADSGQYVLTHPNAKIPQVPAGSRSALRPSTSGQS

SEQ ID NO: 23647 - protein, 403 aa, Ralstonia eutropha
MLTQKTKDIVKATAPVLAEHGYDIIKCFYQRMFEAHPELKNVFNMAHQEQGQQQQALARAVYAYAENIEDPNSLMAVLKNIANKHASLGVKPEQYPIVGEHLLAAIKEVLGNAATDDIISAWAQAYGNLADVLMGMESELYERSAEQPGGWKGWRTFVIREKRPESDVITSFILEPADGGPVVNFEPGQYTSVAIDVPALGLQQIRQYSLSDMPNGRSYRISVKREGGGPQPPGYVSNLLHDHVNVGDQVKLAAPYGSFHIDVDAKTPIVLISGGVGLTPMVSMLKVALQAPPRQVVFVHGARNSAVHAMRDRLREAAKTYENLDLFVFYDQPLPEDVQGRDYDYPGLVDVKQIEKSILLPDADYYICGPIPFMRMQHDALKNLGIHEARIHYEVFGPDLFAE

SEQ ID NO: 23648 - protein, 426 aa, Ralstonia eutropha
MATPHPARAPIPPGAYTTLASSTFAFTICFAVWMLFAVLGIPLKKELGLNDTEFGLLAATPVLSGSLIRVPLGLWTDRYGGRIVFFVLMLATVIPIWLISYAHSLWQLLVLGLFVGLAGGSFSVGTPYVARWFPRSRQGLAMGIFGAGNSGAALTKFVAPAMILAAGTWEIVPRVYSLAMLATALVFWVFSRSNPAHLVKSSTGWREQLSMLRDPRVWRYSQYYSVVFGGYVGLSLWMTKYYIGEYGFDIKTAAFLAACFSLPGGALRAIGGWISDRYGAHRTTWWVMWVSWVGFFLLSYPQTDFIVQTTSGPQGFRIALTPTVFTLLLFVVGIAFAIGKASVFKFISNDFNHNIGAVSGVVGLAGGLGGFVLPILFGMLADLTGIRSSCFMLMYGTVCVSLVWMHYSHRTERQRKEQAVGLTQPA

SEQ ID NO: 23649 - protein, 142 aa, Campylobacter coli
MTQEQIQIIKDCVPILQKNGEDLTKEFYKIMFNDYPEVKPMFNMEKQASGEQPKALAMAILMAAKNIENLENMRSFVDKVAITHTKLNVKEEHYPIVGACLLKAIKVVLYADETTLKAWEEANKAIAQFYIDIEKEIYAKAK

SEQ ID NO: 23650 - protein, 185 aa, Vitis vinifera
NPPSYRDANKVYAKCLRGVADKLLSRLSVGLGLGEKELRESVGGDELTYLLKINYYPPCPRPDLALGVVAHTDMSAIAILVPNHVQGLQLFRDDHWFDVKYIPNALVIHIGDQLEILSNGKYKSVLHRTTVNKDMTRMSWPVFLEPPPELAIGPLPKLTSEDNPPKYKKKRYCDYVYCKLNKIPQ

SEQ ID NO: 23651 - protein, 400 aa, Rattus norvegicus
MKPAAEEEQLGRATDVTESLLEKYVLSTTLLVKYSKEQEDVLGVTSESDPAEAALNRLGAMNIFDRKINFDALLKFSHITPSTQQHLKKVYASFALCMFVAAAGAYVHVVTRFIQAGLLSALGALALMICLMATPHSHETEQKRLGLLAGFAFLTGVGLGPALELCIAINPSILPTAFMGTAMIFTCFSLSALYARRRSYLFLGGILMSAMSLMFVSSLGNLFFGSIWLFQANLYMGLLVMCGFVLFDTQLIIEKAEHGDKDYIWHCIDLFLDFVTLFRKLMLILAFNEKKPIDQTVGHLSLHGEVATGVVVALATKPLTARYQEDGGFDFLHSKPVQLTQWLLVHCPMKLLLVWCAQSDILPPCLPGASPGSSLQPEGRQQLSRKMMPRGLRTRLSSTS

SEQ ID NO: 23652 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 23653 - protein, 600 aa, Homo sapiens
MSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNDVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQKSRRDRSTSPWPRPRALPLRGAVGSCPPGRAAARGASDLQSNRHP

SEQ ID NO: 23654 - protein, 431 aa, Lupinus luteus
MPSIAHSHVAAEPQHPKGENKQKNEGRNRRVLKDIGNLVVKQADPVANVPKRTTRNFGCQLLANAQAAAEKNKKPNTDVGNLAVVTKVEQTKKETEHEVIIISSDDEEEEKEKQVVKGGRKAREKVAGRGKNDKAFSAVLSARSKAACGLTHKPKDLVLVDDIDVADIANELEAVEYLDDIYKFYKLTEDDGRVHDYMPSQPDINIKMRSILFDWLIEVHRKFELMQETLYLTLNIVDRFLSMKAVPRRELQLVGISSMLIACKYEEIWAPEVHDFVCISDNAYVRENILIMEKTILSKLEWYLTVPTTYVFLVRYIKASTPYDKKIEDMIFFLAELSLMDYPLVISYCPSMIAASAVYAARCILGRVPYWTETLKHYTGYYEEQLRDCAKLMVNFHSVAPESKLRAVYKKFSSLERGAVALVAPTKNLLA

SEQ ID NO: 23655 - protein, 383 aa, Ceratopteris richardii
MNTFLSSGPHTYLNNLRCGEWGSGTAPGPIADPKSAAYYRDHTKNDKVNDLSNRLHSYGPPEALQYPNQHAIAADTEKMEVENSGKMAASVERSAQDAHASGALQEDVVAAYVDNMPACVAGVTLVPQGGRGTIPIRRIDNPTSRQVTFSKRRNGLLKKAYELSVLCDAEVGVMVFSATGRLSEFASTSMQKVLERYQEHSNGAPSRKVLLQDVEFWKREVLFLRDQLFHLKNYENHILGENQIPLDLAEIQRVETRLENALNKIRIQKVQVLHGEMQQIYKQEARLFEENNILRKKLAEATTINGMRGSMSTMTMSHEDLPGSTNQSYGTKALQGGCPSDTSTTTSNDPNHHSSHPPSHPSASQPLTLHLTSPCSPKLDLRL

SEQ ID NO: 23656 - protein, 239 aa, Ceratopteris richardii
MVRRKIKIKRIENATTRQVTFSKRRGGLLKKAHDLSVLCDADVGVIIFSSKGKLFQFANPSMKSVLERYYKAQGDAESADNVSSAENIEIDRITLFTEKLKALQRNVIGDDLERLSLRDLIHLEQQIHESLGRIRAKKEEMILDQLEDFKKKVTDARKTTNANSSLLDKLLDFCSSDMTSSHNFVDCEPLLISEAPQADASLAGRAATSEQSTDVRECSPPAKRLRITEDLNHSPVCME

SEQ ID NO: 23657 - protein, 238 aa, Ceratopteris richardii
MVRRKIKIKRIENATTRQVTFSKRRGGLLKKAHDLSVLCDAEVAVIIFSSKGKLFQFANPSMETVLGRYVKASRDPEAGDNGSSTDNVEADRLTVFTEKLKMLQSNVIGDDLERLSLRDLIHLEQQVHESLGHIRAKKDELILEQIDEFKQKMADTRRTTNANTSMLDRLVDFCSSGITGSQNIVASEPGYVVGVPRTDTLRAGWIATSDQSNDGPEYVPCAKRFRITEGLNESPASE

SEQ ID NO: 23658 - protein, 538 aa, Caenorhabditis elegans
MSLIRRLSVVLIGLLLILGYAQAECDEKEEEVFPSRYPIAYFKWEEVKIPMTICLWLIAASISKIVFNSIPHLNDLFPDSALLIMIGLIIGIIFKLIGVDKNQFFLESEIFMLYLLPPLVFDAGYFMPARQFFDNFGSIMCFAMIGTLFNFLAISFSLWAISLTGLFSVETPLLHMLLFGSVAADVDPVAVIVIFEELAVNDVLFIAVFGESLFNDGVSVVLYRMFLTFSEIGAENLIPEDFANGGVSFLVVVFGGVGIGVLFAFLASLLTKYSRAEEISILNCVFILILPYTCYLCGELFGLSSIIAVVFCGALMRQYCRENVEQETVKATEKFIKVLSIASETVIFVFLGLSTVSSNHHWDTCFIVLTVVFCLIYRTLGVVVMCHFLNKYRLNKYTKVDQFIMAYGGLRGAIAYGLVVAIPDFIPAKNMFVTSCIIVIYFTVFLQGITLKPIAEFLQVEKKNVHSKNMIEHIYTELIDTTMAGMEDIAGFKGHHWIRDSWNYFNNCYLRPVLVNKNNMKQMDKTKLVRKYKVGLGS

SEQ ID NO: 23659 - protein, 967 aa, Caenorhabditis elegans
MRATFHLFTFIFLLLFSSVICISTPGFRNDHESIGDDEEKTSSTILVSTIDGRLRALDSETGEIKWTLQEEPVLRSPSAVKQGFTFLPNPLDGSLYVLKNSSLKKLPFNIPQLVHASPCKGNDGILYAGSKKDVWFGIDPKTGLKVETLSSASADRICPANQKQTIFLGRTEYRVSMFDEKNRGKTWNATFNDYSAHLLPEVNTWPFKHYASSSHGYILTFDRETGEMRWEQDLKQPVVALYLLRDDGLHKLPFEVMGKETMENVAKNIFTVDQWPTVLGVNAADPQTTSLTNQFFPALFVGESSFGLYAIEALVDHQTITYSPKLLGPPLLEGPAPIALTEMEKEEYLPPRRPIIRNIPPSITHKTSDGEYLLLGYHDRPMMTMATIIPTRYPVPGPHKAIGSTIERPPPQLLGPVEPQKHEDTSFILLLLNNHPIPFYATLVTMFALLLTVIWQCGRQWDQQKSTSRMDSFEIVNNPGESRSAQTSKQSNRGSFGWANRKIEIPEGWMAVGSKLMYSPSDILGTGCEGTVVYRGTFDGREVAVKRVVSEFVKFAHREADLLRESDTHPHVIRYFCMESDSQFRYLALELCIASLNDYVEQKEVQQNVTIALRDIMKQATDGLAHLHASKIVHRDMKPQNVLITMASQRGEMRAVISDFGLCKRVQPGKNSISRGIASGLAGTDGWIAPEVLISASTSYPVDIFSLGCIFYYVLTSGTHPFGKSLHRQANIVNGEYTLNKLADLDDWSLADDLISSMLNVEPLHRLTADAVLNHPFFWTSEKRLAYFSDVSDRVEKEEDNSPVVRRIETDARIVVCGGWREKICDALKEDLRKFRTYKSFSVRDLLRAMRNKKHHYRELPEDVRQSLGDIPDQFLHYFTSRFPRLLLHVYKATEYCSGEAVFKRYYSDDVRARMYPIVEEEERVRKKIKEEMANEVWARAPKPVEQRTPLKLDKRNIKKKSNPNTD

SEQ ID NO: 23660 - protein, 2695 aa, Caenorhabditis elegans
MLQQHGISFQMNADRQNKAATTSNRIVSAPATNEFDERHRKQGIDAARALASQYRSRITENRDANQRQAARELSRYVRSELKDEPNTFSDAFLNAIDGRTDIASQSAIYNCMKSNSNIDQKRAGIYLIVCLAETHSGNVIRYANYLLKMLNNGNGLDEDTVKMASKALAFLIATCKSYAAELVDRCLDHCHEWLGQNVPHSQQPKNQQEIDQIRRLAASHLSRELALATPTAFFLRVNLFFKYIFNAVRDKNPAVRIAGIDALHVVLTIVSQREAKNKTEWFKKCFDEALEGQPNPSQKDDLDRWHAVALILNELLRISDQRFELIRCESSQFIKQKFLKEDEEEGVEWLVLTKQQTIVESVTARKLVLERFPKILDCVRQIIPLANKTSSTKQQSSIYLNTVLMQLLPRICAFPQCDRTFQTISFDTSFTILQRNAVAAPAIGMMMLSNPDVHATHIEKTISFISAAIKKTTNSDVLDNYFTFLFLFVDAYHEQVTTQIKAIIPQLMDITLSRSLANVLKMIMMRIPKLRLNVQDGVMASVYQTLTGSLIPPKSEPIGRPASPKAILQKAETDPKELQRIVLAVDVLGEFYFSRGALQRIMQYVADYYLTADNVEIRLAAVSSCCEMVVPFVGVYKKVTSDKRNSLLQTIYGVLRAVCSVIVNDQDVRVRMQVISCFGQMPRPFLAHLAQPEMLEVQFMALHDEKLEMQQACVTLLGRLAELNPALVLPRLRLMLLETLSQMQQSGQARLEQHSAKMIAQLAKQSPKFMRPYVGSLMIAMIPKLRNDQKYAEVTAQVLNAVSEIAVIGGAEIVKNLKPLFEKLTHMINDSSSLHKREAALRAIGGICRSTAYVVDPYRDYPSLLDDLLRILKTVMSNTMRREAIKTLGILGAIDPYTHKVFTGSVQSSTAISTALSLPISETDSKDPRQDIIHWFNYEKCTLEEFYPAITIANLMLMMQDEDSQSYAEIAQAIVTIFRSLGDMAPLYTEQVIPRLIEVCRRATESSNRANLREFFLQQLANFVAIIRKHAAPYMPAIFTIIADAWKEDISVKMVVIEVLTDMGTAIGNDFSKYTGELIPYLLTVLQTDKTKERVLTVKVMESIQKLTHCIVQHLHLVLPPLLIILDDFSLKLSIRNTALSTVLHMTQQVDVSAYAPRMMQSWHHNISTAEMRDKLLLLLIEIIKQLGKFFDIFKRGVDQKLRDYNLDKSVHYEQYRKLAQRAQMSRDVLTSSVFAGSNGNIQYSSTQAGMRGQANNVYANNDLHERLMNGSIDSGASRQDNRDDYYRYGVEEKISEEVPKVAPTTARPTSELVTVQITKQRLNKDALMPQWKNENLTSKDEWLQWLMKIRIGFLTYGSSPSLRAASSLGDQHPHLARDLFPAAFMSVWTELDSDVQNDLTSCLLRAISTGIPELIQTILNLAEFMDHSEKGPLPISHDVLGRWAEQTKAFAKACRYKEMSVLKKSGSMQTTFTRKVKLEPNDCQSLITYANKLNVQEEAAGVVRYAERNEMNFQMRGRWYEKLNEWEKALGAYELEEKKKSSCPNLQVYDEKDHLMTPEEAATAEEARMHEMRCLEALGRWDELNSKSVVWADQRGNRNDSVRDEINKKQLDHKMAVIAARGAWAVDNWERMADYVSVISENTQDGAMLRAVVAVHNDENTKAMGLIEKVREMIDSELTAMANESYERAYIPMVSVQQMAELEEAIEYKTRPERRPRIALLWSRRLQGCRRNVEQWQRLIMLRGLVLSPQEMHPLRVKFSSMCRKQGKNSMSRAVLRELLSLPANSDLVRAKAPFDKPLLVLALAKQLYQDDHKDEAIRALEDLANHWNKRINPIPKATGRELIPPSTKEPARICAKVLLKLGEWTELKSKTSNNMQVGELSFVRQQVSPQYRTKESRTPETIAFENTINYYQQATQYDPGWHKVWHKLASTHFYAVCRERPHPTTVISPPQQPQQPKKMHIPPVTRATSPPPPAQKSPQPAPFHSITEPLSVIIDYPVPPPLGSLVGLPPMPAYLSSNSSLPPQHHHVSPLSNDSPSNSAENKLYLKHAAHAVRCFAKALMCSPGSRLEDTLRLMQLWFDHGDDKDQDVYFALTETIFDLPVTTWLEAIPQLMARLDCPDDQKSVQLVLRVLCEIARHRPQAVIYALTVASRSKDVHRSKNAGTVLEKMMEYHSKLVREASLVTEELVRCAILWHEQWHDALDDASRVYFHDNNVQAMFDALRNMNDLMQKGAPTTMKEHSFQQTYSSDLKEAGRYVQAFESSGNVKDLNQAWEIYCSVFKKLRDQLATLNSLDLVYVSPNLVSAKDLELVVPGTYDPSAPIVSIQSFSSKMNVITSKQRPRKMVIRGSNGLDYQFLLKGHEDPRQDERVMQLFGLVNTLLANNSETCRRNLTIQRYSIVALSKDSGLIGWVPNCDTLHTLVKEYREKKAKIPLSIEHKTLQKLSLETEHLTLMQKLQLFESALSVTQGEDLRHVLWLKSPSSEVWFDRRTNYTRSVACMSMVGYILGLGDRHPSNLMLDRLTGKVVHIDFGDCFEVAMLREKFPERVPFRLTRMLINAMEVTGLDGVYNYTAERVLKMLRTNQESLLAVLEAFVYDPVINWRLVEGMKKDPKTRKDTGGRQNMAGAVLPSSSTTDSIMETIKRKLDGTEFVHTDGSTPPEPLQVTEQLAMLTEQATSPLNLCQSYIGWCPFW

SEQ ID NO: 23661 - protein, 2692 aa, Caenorhabditis elegans
MLQQHGISFQMNADRQNKAATTSNRIVSAPATNEFDERHRKQGIDAARALASQYRSRITENRDANQRQAARELSRYVRSELKDEPNTFSDAFLNAIDGRTDIASQSAIYNCMKSNSNIDQKRAGIYLIVCLAETHSGNVIRYANYLLKMLNNGNGLDEDTVKMASKALAFLIATCKSYAAELVDRCLDHCHEWLGQNVPHSQQPKNQQEIDQIRRLAASHLSRELALATPTAFFLRVNLFFKYIFNAVRDKNPAVRIAGIDALHVVLTIVSQREAKNKTEWFKKCFDEALEGQPNPSQKDDLDRWHAVALILNELLRISDQRFELIRCESSQFIKQKFLKEDEEEGVEWLVLTKQQTIVESVTARKLVLERFPKILDCVRQIIPLANKTSSTKQQSSIYLNTVLMQLLPRICAFPQCDRTFQTISFDTSFTILQRNAVAAPAIGMMMLSNPDVHATHIEKTISFISAAIKKTTNSDVLDNYFTFLFLFVDAYHEQVTTQIKAIIPQLMDITLSRSLANVLKMIMMRIPKLRLNVQDGVMASVYQTLTGSLIPPKSEPIGRPASPKAILQKAETDPKELQRIVLAVDVLGEFYFSRGALQRIMQYVADYYLTADNVEIRLAAVSSCCEMVVPFVGVYKKVTSDKRNSLLQTIYGVLRAVCSVIVNDQDVRVRMQVISCFGQMPRPFLAHLAQPEMLEVQFMALHDEKLEMQQACVTLLGRLAELNPALVLPRLRLMLLETLSQMQQSGQARLEQHSAKMIAQLAKQSPKFMRPYVGSLMIAMIPKLRNDQKYAEVTAQVLNAVSEIAVIGGAEIVKNLKPLFEKLTHMINDSSSLHKREAALRAIGGICRSTAYVVDPYRDYPSLLDDLLRILKTVMSNTMRREAIKTLGILGAIDPYTHKVFTGSVQSSTAISTALSLPISETDSKDPRQDIIHWFNYEKCTLEEFYPAITIANLMLMMQDEDSQSYAEIAQAIVTIFRSLGDMAPLYTEQVIPRLIEVCRRATESSNRANLREFFLQQLANFVAIIRKHAAPYMPAIFTIIADAWKEDISVKMVVIEVLTDMGTAIGNDFSKYTGELIPYLLTVLQTDKTKERVLTVKVMESIQKLTHCIVQHLHLVLPPLLIILDDFSLKLSIRNTALSTVLHMTQQVDVSAYAPRMMQSWHHNISTAEMRDKLLLLLIEIIKQLGKFFDIFKRGVDQKLRDYNLDKSVHYEQYRKLAQRAQMSRDVLTSSVFAGSNGNIQYSSTQAGMRGQANNVYANNDLHERLMNGSIDSGASRQDNRDDYYRYGVEEKISEEVPKVAPTTARPTSELVTVQITKQRLNKDALMPQWKNENLTSKDEWLQWLMKIRIGFLTYGSSPSLRAASSLGDQHPHLARDLFPAAFMSVWTELDSDVQNDLTSCLLRAISTGIPELIQTILNLAEFMDHSEKGPLPISHDVLGRWAEQTKAFAKACRYKEMSVLKKSGSMQTTFTRKVKLEPNDCQSLITYANKLNVQEEAAGVVRYAERNEMNFQMRGRWYEKLNEWEKALGAYELEEKKKSSCPNLQVYDEKDHLMTPEEAATAEEARMHEMRCLEALGRWDELNSKSVVWADQRGNRNDSVRDEINKKQLDHKMAVIAARGAWAVDNWERMADYVSVISENTQDGAMLRAVVAVHNDENTKAMGLIEKVREMIDSELTAMANESYERAYIPMVSVQQMAELEEAIEYKTRPERRPRIALLWSRRLQGCRRNVEQWQRLIMLRGLVLSPQEMHPLRVKFSSMCRKQGKNSMSRAVLRELLSLPANSDLVRAKAPFDKPLLVLALAKQLYQDDHKDEAIRALEDLANHWNKRINPIPKATGRELIPPSTKEPARICAKVLLKLGEWTELKSKTSNNMQVGELSFVRQQVSPQYRTKESRTPETIAFENTINYYQQATQYDPGWHKVWHKLASTHFYAVCRERPHPTTVISPPQQPQQPKKMHIPPVTRATSPPPPAQKSPQPAPFHSITEPLSDYPVPPPLGSLVGLPPMPAYLSSNSSLPPQHHHVSPLSNDSPSNSAENKLYLKHAAHAVRCFAKALMCSPGSRLEDTLRLMQLWFDHGDDKDQDVYFALTETIFDLPVTTWLEAIPQLMARLDCPDDQKSVQLVLRVLCEIARHRPQAVIYALTVASRSKDVHRSKNAGTVLEKMMEYHSKLVREASLVTEELVRCAILWHEQWHDALDDASRVYFHDNNVQAMFDALRNMNDLMQKGAPTTMKEHSFQQTYSSDLKEAGRYVQAFESSGNVKDLNQAWEIYCSVFKKLRDQLATLNSLDLVYVSPNLVSAKDLELVVPGTYDPSAPIVSIQSFSSKMNVITSKQRPRKMVIRGSNGLDYQFLLKGHEDPRQDERVMQLFGLVNTLLANNSETCRRNLTIQRYSIVALSKDSGLIGWVPNCDTLHTLVKEYREKKAKIPLSIEHKTLQKLSLETEHLTLMQKLQLFESALSVTQGEDLRHVLWLKSPSSEVWFDRRTNYTRSVACMSMVGYILGLGDRHPSNLMLDRLTGKVVHIDFGDCFEVAMLREKFPERVPFRLTRMLINAMEVTGLDGVYNYTAERVLKMLRTNQESLLAVLEAFVYDPVINWRLVEGMKKDPKTRKDTGGRQNMAGAVLPSSSTTDSIMETIKRKLDGTEFVHTDGSTPPEPLQVTEQLAMLTEQATSPLNLCQSYIGWCPFW

SEQ ID NO: 23662 - protein, 444 aa, Caenorhabditis elegans
MPTWIPNNFFAQPTTRNAKPPSNGHPQATQQQSAPGSLAYRNSSNIPNGATNHVRQQKWQYTRSGHRKMADGEAVISTVNNVEEVHGQLFEVAPRYVNLSYIGEGAYGMVASALDTITRDRVAIKKISPFEHQTFCQRTLREIKILNRFKHENIINIQEIIRSETVDSLKDIYIVQCLMETDLYKLLKTQKLSNDHVCYFLYQILRGLKYIHSANVLHRDLKPSNLLLNTTCDLKICDFGLARVTDPQTDHTGFLTEYVATRWYRAPEIMLNSKGYTKSIDVWSVGCILAEMLSNRPLFPGKHYLDQLNLILAVVGSPSNADLQCIINDKARSYLISLPHKPKQPWARLYPGADPRALDLLDKMLTFNPHNRIDIEQALAHPYLEQYYDPGDEPVCEEPFTLEMEFDDLPKEKLKELIWEEAEAHHRRMEAEAAARNNGGQNPV

SEQ ID NO: 23663 - protein, 376 aa, Caenorhabditis elegans
MADGEAVISTVNNVEEVHGQLFEVAPRYVNLSYIGEGAYGMVASALDTITRDRVAIKKISPFEHQTFCQRTLREIKILNRFKHENIINIQEIIRSETVDSLKDIYIVQCLMETDLYKLLKTQKLSNDHVCYFLYQILRGLKYIHSANVLHRDLKPSNLLLNTTCDLKICDFGLARVTDPQTDHTGFLTEYVATRWYRAPEIMLNSKGYTKSIDVWSVGCILAEMLSNRPLFPGKHYLDQLNLILAVVGSPSNADLQCIINDKARSYLISLPHKPKQPWARLYPGADPRALDLLDKMLTFNPHNRIDIEQALAHPYLEQYYDPGDEPVCEEPFTLEMEFDDLPKEKLKELIWEEAEAHHRRMEAEAAARNNGGQNPV

SEQ ID NO: 23664 - protein, 422 aa, Caenorhabditis elegans
MDASQRGVLLNRLADLMERDRVILASLESLDNGKPYAVAYNADLPLSIKTLRYYAGWADKNHGKTIPIEGDYFTYTRHEPVGVCGQIIPWNFPLLMQAWKLGPALAMGNTVVMKVAEQTPLSALHVAALTKEAGFPDGVVNIIPGYGHTAGQAISSHMDVDKVAFTGSTEVGRLVMKAAAESNVKKVTLELGGKSPNIIFADADLNDSVHQANHGLFFNQGQCCCAGSRTFVEGKIYDDFVARSKELAEKAVIGDPFDLKTTQGPQVDGKQVETILKYIAAGKKDGAQLVTGGAKHGDQGHFVKPTIFANVKDQMTIAQEEIFGPVMTIIRFDTMEELVEKANNTIYGLAAGVMTKDIDKALHIANATRAGSVWVNCYDVFDAAAPFGGFKQSGIGRELGEYGLEAYTEVKTVTIKVPQKNS

SEQ ID NO: 23665 - protein, 475 aa, Caenorhabditis elegans
MSTDQQSSVEDQTVAMVNVRRANFKSFWDKYSDKPDTNSMMLNHSAEELESSDRADILASLPLLHNKDVVDIGAGIGRFTTVLAETARWVLSTDFIDSFIKKNQERNAHLGNINYQVGDAVGLKMESNSVDLVFTNWLMMYLSDEETVEFIFNCMRWLRSHGIVHLRESCSEPSTGRSKAKSMHDTANANPTHYRFSSLYINLLRAIRYRDVDNKLWRFNVQWSCSVPTYIKRSNNWRQVHWLAEKVPAEDGAKGTSFNELVELIKNTWQNEQEAWDAKLDDEKYVWTDKVFSSALTSLPSNSTFFLYTPRTVSPYCHINAHTLAETFNANVWNTEIIPEYYRTSLTKSNNLKDQRVRFGWNQSLTDSVTYWQQKDALFDVFVATEFLSTVDDETIRQLPNVMSDGAKFITLEPVDEVNEAEMKQRIQELGYTLKSFTDVTDQCIEAQEQYFKDHEQLRDEKVIRKNWVLLELTH

SEQ ID NO: 23666 - protein, 351 aa, Caenorhabditis elegans
MESNSVDLVFTNWLMMYLSDEETVEFIFNCMRWLRSHGIVHLRESCSEPSTGRSKAKSMHDTANANPTHYRFSSLYINLLRAIRYRDVDNKLWRFNVQWSCSVPTYIKRSNNWRQVHWLAEKVPAEDGAKGTSFNELVELIKNTWQNEQEAWDAKLDDEKYVWTDKVFSSALTSLPSNSTFFLYTPRTVSPYCHINAHTLAETFNANVWNTEIIPEYYRTSLTKSNNLKDQRVRFGWNQSLTDSVTYWQQKDALFDVFVATEFLSTVDDETIRQLPNVMSDGAKFITLEPVDEVNEAEMKQRIQELGYTLKSFTDVTDQCIEAQEQYFKDHEQLRDEKVIRKNWVLLELTH

SEQ ID NO: 23667 - protein, 460 aa, Caenorhabditis elegans
MVNVRRANFKSFWDKYSDKPDTNSMMLNHSAEELESSDRADILASLPLLHNKDVVDIGAGIGRFTTVLAETARWVLSTDFIDSFIKKNQERNAHLGNINYQVGDAVGLKMESNSVDLVFTNWLMMYLSDEETVEFIFNCMRWLRSHGIVHLRESCSEPSTGRSKAKSMHDTANANPTHYRFSSLYINLLRAIRYRDVDNKLWRFNVQWSCSVPTYIKRSNNWRQVHWLAEKVPAEDGAKGTSFNELVELIKNTWQNEQEAWDAKLDDEKYVWTDKVFSSALTSLPSNSTFFLYTPRTVSPYCHINAHTLAETFNANVWNTEIIPEYYRTSLTKSNNLKDQRVRFGWNQSLTDSVTYWQQKDALFDVFVATEFLSTVDDETIRQLPNVMSDGAKFITLEPVDEVNEAEMKQRIQELGYTLKSFTDVTDQCIEAQEQYFKDHEQLRDEKVIRKNWVLLELTH

SEQ ID NO: 23668 - protein, 765 aa, Caenorhabditis elegans
MSEGSGDQSQQRPWASPRQQPIKGIVQPRVLPPFGKPTRHTNKLDYIMTTVLKEAGKHKHVWPFQKPVDAVALCIPLYHERVARPMDLKTIENRLKSTYYTCAQECIDDIETVFQNCYTFNGKEDDVTIMAQNVHEVIKKSLEQAPREEHDMDVYWGKNKKKPAKSDGGSKSSSSKKNDARGPSEAPSEAGSEVSSVTTASAAAPTVSESASVAAKPERKVAGKKTGKRKAESEDDEKPEPLRAKREVAVVKKEVHQPLLPSMKPCLKLLNDFSTKKYQEFAWPFNEPVDAEQLGLHDYHKIIKEPMDLKSMKAKMESGAYKEPSDFEHDVRLMLRNCFLYNPVGDPVHSFGLRFQEVFDRRWAELGDSSSRASSVAPQSAPIAPTPKVAKSSAPKEPKESRKEHKKETTFEASGAKSEDLMQINNALSMIREREEKLKAELAAAQAIKDKLTSVKNRREDNPNEPFPEKLINETRALCTTQVGQNASSSSASSAALRNGRSKKAASARLYGYEFDSDDEDNKMALTYEEKRNLSNLINNLPNNQLNTIISIIQRRERSALMQQQLDDSEVELDFESLGDMCLREMGAFIKTIPTLNGNGDDEKPKTSSNPTSSGATGSKGSSSLESKNGKKKKNFNMSESSDDETSNSRKRRKRESSESQSSSSSDDDSDDEDRPSIPRKSGQPPSTSREWNQSSAPPPRMGGMGGQPPMSRVPASSSTSVSAIGKNNAAASSNSYQKFYNCFHSYTPPLKVEKKIIKLLVNFC

SEQ ID NO: 23669 - protein, 225 aa, Caenorhabditis elegans
MTTSLGQTILPYLSFTALSSTVAFFLCGLQICHRIKTRGSSEGTSPAPFLLSFLSCGLFIQYGLLKDDDVITYCNGIGCFLQACYLMYFYYMTRNRRFLNKVISIELGIIGIVVYWVAHSTNSHLTKTTYVGNYCIFLNICSVAAPLFDIGKVVRNKSSESLPLPLCVACFVVCLQWMFYGYIVDDIVILVPNVIATVISILQLSLFIIYPGAPAGVLPQKYEHI

SEQ ID NO: 23670 - protein, 482 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKGAILTTMIATRNLSNLGRNLLNKKEQGPPSTIKESSESSQTIDDNDSEKAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 23671 - protein, 520 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKGAILTTMIATRNLSNLGRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 23672 - protein, 533 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKAAISAVKMVTRMSGVLRTSDSTGSVASNGSTTHDASQVAGTSSQPTSPAAEGAILTTMIATRNLSNLGRNLLNKKEQGPPSTIKESSESSQTIDDNDSEKAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 23673 - protein, 571 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKAAISAVKMVTRMSGVLRTSDSTGSVASNGSTTHDASQVAGTSSQPTSPAAEGAILTTMIATRNLSNLGRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 23674 - protein, 302 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKVVDS

SEQ ID NO: 23675 - protein, 302 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKVAIC

SEQ ID NO: 23676 - protein, 418 aa, Caenorhabditis elegans
MLKTRSTVTLYRAPDYYSKNVFLEEQSGSKSCSNDLFCLEATQYLAQENLGAGAFGVVCRAIDSKLNKQVAIKKITRVFKNQSTAKCALREIRITRELSHENIINSTDVLMRESGSGQDIYIVMDLMETDLLSVLKSNQTLNEKHFQYFFYQILKGLKYLHSAGIIHRDLKPANLLLNEDCSLKIADFGMSRSGPSTKTTPNTSPNAHISGDLSQYVSTLWYRAPEILLSMGEYDTQVDIWSAGCILAEMLLLRPIFTGTDSYSQIQLLIEYLGTPDEQVIRRIKSPSIRDYISSFGPKTPLPFTAMFPNASIEARNIVSKMLQISPWKRFSAEQLLEEPFVKHWHTVKNEPSCPNHIRQNLLETAKYEGDVIIKGLQEEVRIFEKKQKVYPSEGSKVTHKNSLKQVFGKILFKNNKI

SEQ ID NO: 23677 - protein, 476 aa, Caenorhabditis elegans
MGEIAPEMEISQYTKDKASCTRISIESYYSKRVTQCAERENRLKKLEEDISARGLSDEEKEEKRKIHHSKETDYLRLKRTRLTVNDFESLKVIGRGAFGEVRLVQKHDTGHIYAMKILRKSEMVEKEQTAHVRAERDILSEADCDWVVKMYYSFQDYSNLYLVMEFLPGGDMMTLLIKKDTLTEEATQFYIAEAALAIQFIHSLGFIHRDIKPDNLLLDARGHVKLSDFGLCTGLKKFHRTDHYRNWPSTLPPDFISKPFESKRKAETWKRNRRAYAYSTVGTPDYIAPEVFQPNGYTKSCDWWSLGVIMYEMLIGYPPFCSELPQETYRKVINWQQTLVFPSDVPISIEAKATIKRFCCEAERRLGNHGGLDEIKQCPFVKRIDWNHIRERPPPIRVTVKSIDDTSNFDDFPDEDLTWPTSTLIRPEEQPGRRGEFVDFTYKRFDGLTQKMRYSDLKKFQQAKKNKKGGQQGTSD

SEQ ID NO: 23678 - protein, 771 aa, Caenorhabditis elegans
MGRKKHRTIPAVEVYEKSDGFPMPTAPPMSPSRMDGVYPSHHVPPLHQAYHVQPASANHVPDQIARFNVIKPDRLAKRHNPQLYTKRGCTDVFCCFLFFVFLCGWVVVAGFGIMWGDPQRLIYPTDSEFRRCGVNLEGSYNFSKRPYLFYFDLTKCISYATALGGCQTTQLCVKECPSTYFSYLQLRTASVSEIQNKMKSVVYCTDDVDKTTVTTFQALQNLVQRGKCVSYTVKSVPVLQRCFPEAIFNAVDNVNNVLNSSNSLDYLKRTFGDDALIPQDIQITGQSSEVMKSVVEDQPVTHKVIHDLSQTWWQTLILIFAAGILSFIWTVIMRLLGSLIIWLSILIVLVALGFGAGFSWLKWNTLKTTGAIDDYSFHPAFDAYFEMPTTWLVVAIATSVLLLIFLLVILFIRQRISIACALISESSKAIGSMMSTLLFPLFPFLLHIGVFALWGSIAIWLASSGQEVCRLKETNGQVYNTSTKCDCTAKVTGCTYVGIEKESETIFWLQVYNLFAFFWLSCFVTALGDIALAGAFASYYWARDKRHDVPTFPVIRALNRAIRYNLGSIAFGSLIIAIVKIIRVLLEYIDHKLGKSQNKAVKWFLMCLKCCFWCLEVFFKFLTKNAYIMIAIYGKNFFSSAKDSFLLITRNIVRTVVVHKVAGILLFLGKSMITLGMGILSFYYFSGRWVVEGVPKVDLYYYFVPIVIVVIGSYFMADLFFDVYEMAVDTTFICFLEDSEQNDGSLERPFFMSEKLLEILGNKNDIPLHSK

SEQ ID NO: 23679 - protein, 730 aa, Caenorhabditis elegans
MKQYNYSYEAAPQFCRNSAMAIQTAPGTAESKRDNNPMSDFNLQRRGCTDVFCCFLFFVFLCGWVVVAGFGIMWGDPQRLIYPTDSEFRRCGVNLEGSYNFSKRPYLFYFDLTKCISYATALGGCQTTQLCVKECPSTYFSYLQLRTASVSEIQNKMKSVVYCTDDVDKTTVTTFQALQNLVQRGKCVSYTVKSVPVLQRCFPEAIFNAVDNVNNVLNSSNSLDYLKRTFGDDALIPQDIQITGQSSEVMKSVVEDQPVTHKVIHDLSQTWWQTLILIFAAGILSFIWTVIMRLLGSLIIWLSILIVLVALGFGAGFSWLKWNTLKTTGAIDDYSFHPAFDAYFEMPTTWLVVAIATSVLLLIFLLVILFIRQRISIACALISESSKAIGSMMSTLLFPLFPFLLHIGVFALWGSIAIWLASSGQEVCRLKETNGQVYNTSTKCDCTAKVTGCTYVGIEKESETIFWLQVYNLFAFFWLSCFVTALGDIALAGAFASYYWARDKRHDVPTFPVIRALNRAIRYNLGSIAFGSLIIAIVKIIRVLLEYIDHKLGKSQNKAVKWFLMCLKCCFWCLEVFFKFLTKNAYIMIAIYGKNFFSSAKDSFLLITRNIVRTVVVHKVAGILLFLGKSMITLGMGILSFYYFSGRWVVEGVPKVDLYYYFVPIVIVVIGSYFMADLFFDVYEMAVDTTFICFLEDSEQNDGSLERPFFMSEKLLEILGNKNDIPLHSK

SEQ ID NO: 23680 - protein, 168 aa, Caenorhabditis elegans
MSAPVSDAPAAQIFYKIISNDGVVTKMSEKAVQQSKTLSNLIENLGYTIENIETRDPIPVTNVNGKTMEKVAEWCEKHNADAIPEDNMNVLKTLTIPEWDQKFLKIEDEALFDLILASNFLDIKGLMYYGCKTVSNMAKGKTTAELREIFGINTDEQDAAEGGAVEVA

SEQ ID NO: 23681 - protein, 390 aa, Arabidopsis thaliana
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRLLVPQPLLKGIAGQYVWEDHRPRSGLWKGTAGGEAISISGCDDDQTSADTSLVPPLMIKTHTQALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 23682 - protein, 67 aa, Heterodera glycines
NSPDKACQLAKQAFDDAIAELDTLNEDSYKDSTLIMQLLRDNLTLWTSDTAGDEQEAGGEAGEAGGN

SEQ ID NO: 23683 - protein, 158 aa, Heterodera glycines
LAADCGKADARESKGLADCIMRSSSRTVPSGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGALVLAFYDEIQKYIH

SEQ ID NO: 23684 - protein, 280 aa, Prunus armeniaca
EKSAKRKRKNQYRGIRQRPWGKWAAEIRDPRKGVRVWLGTFNTAEEAARAYDSEARRIRGKKAKVNFPDETPRSSAKRSVKANPQKMQPKTNMNAIQPNLNQNINFVNDPNQDYYNAMGFLDEKPPTNNFGFMSTFPANDVALKSSTPSDAVPLYFGSDQGSNSFDCSDFGWGEQGSKTPEISSVLSSVMEESDDSLFLEDASPTKKLRSNPEDLVPVQDNAGKTLTDELSAFEMKYFQTPYLDGSWDASVDAFLSGDATQDGGNSVDLWCFDDLVGGGF

SEQ ID NO: 23685 - protein, 262 aa, Prunus armeniaca
DVTAIHIPSINLEKAEIVVDVLIKNPNPVPIPLIDINYLIESDGRKLVSGLIPDAGTIHAHGEETVKVPVHLVYDDIKNTYDDIKPGSIIPYRFKVDLIVDVPVLGRLTLPLEKTGEIPIPYKPDVDVEKIKFQAFSFEETVAVLHVKLENMNDFDLGLNALDYEIWLSEVNIGGAQLSQSANLAKKGVTFIELPITFRPKDFGSALWDMIRGKGTGYTIKGNINVDTPFGAMKLPIVKEGGTTRLRKNKEDGGDDDDEDED

SEQ ID NO: 23686 - protein, 747 aa, Adoxophyes orana granulovirus
MAKQRKPVSCDETTHLALTIIIIILFFFIIQKISVFDNCEPTPIPPVNPPIVIPPPTPPPTPTPPPTPTPPPTPTPPPTPPPTPTPPPTPTPPPTPTPTPTPPPTPPPTPTPPPTPPPENYLSLVLFNNFIKNTMTEQYNQKAEKNQTLRTWNDQTVFDNLSPWTSPADFGLVCHSIIFYCVNYNNQNHPSYRDPELAYRLYKSLILIASHLPDPAPHQQAPWGPPADWYHFTITMPEVFMNVTAVLNETQYGRECQSLSIYWLGLYLPTAINSMGWVRGAGNAMRMGVPYIYSQLLRGSSQKDINENDHSVQEIKRIVSFPIVNAGNGLHKDYIYIDHINVRAYGYLINSFFTFNYYIYLFGDDYVNAYGLNQSILRVASPEGVVNPALMSRHGTHYSNVIGSFVEYKNDIYSSDHSKVLTKLSNLYYGSVVGTTTRLAYYEADPTNNLHATLWAMNRRIWNRNSPVINYNANSALFESGMLSQTPNGILRVPSTTTSTQTFTPTIGKTALVIANQYGAMLSLSEFDELNGLHFKSCTVFYEEGMYQLYYEMGVRPGSLGTSNGRVVVLSRDAINNNITNDKSFAQQRIDNNNSSDGTTYNGIFCYRVPVVNFNIPSLTTRTQGTIEIVEQVLSFDSLHNGTASCSYKLNVQNDNVSVRSFDTETILFQNNNLYVLFYYPYVAILHLQRLSISDVNETLQIDISTVDRILNLLNINNTIVPINCTLSNDIFTLINNFQLQFWFDLS

SEQ ID NO: 23687 - protein, 795 aa, Homo sapiens
MDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEENKERVEEEGGKPKHVLSTSGLQSDAREPGEESQKADVLERTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 23688 - protein, 144 aa, Homo sapiens
MVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 23689 - protein, 1234 aa, Rattus norvegicus
MAGARPGVHALQLEPPTVVETLRRGSKFIKWDEEASSRNLVTLRLDPNGFFLYWTGPNMEVDTLDISSIRDTRTGRYARLPKDPKIREVLGFGGPDTRLEEKLMTVVAGPDPVNTTFLNFMAVQDDTVKVWSEELFKLAMNILAQNAPEHVLRKAYTKLKLQVNQDGRIPVKNILKMFSADKKRVETALICGLNFNRSESIRPDEFSLEIFERFLNKLLLRPDIDKILLEIGAKGKPYLTLEQLMDFINQKQRDPRLNEVLYPPLRSSQARLLIEKYEPNKQFLERDQMSMEGFSRYLGGEENGILPLEALDLSMDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGEALLIDPLDKYPLSAGTPLPSPQDLMGRILVKNKKRHRPSTGVPDSSVAKRPLEQSNSALSESSAATEPSSPQLGSPSSDSCPGLSNGEEVGLEKTSLEPQKSLGEEGLNRGPNVLMPDRDREDEEEDEEEEETTDPKKPTTDEGTASSEVNATEEMSTLVNYVEPVKFKSFEASRKRNKCFEMSSFVETKAMEQLTKSPMEFVEYNKQQLSRIYPKGTRVDSSNYMPQLFWNVGCQLVALNFQTLDLPMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGRFVGHRILPVSAIRSGYHYVCLRNEANQPLCLPALLIYTEASDYIPDDHQDYAEALINPIKHVSLMDQRAKQLAALIGESEAQASTEMCQETPSQQQGSQLSSNPVPNPLDDSPRWPPGPTTSPTSTSLSSPGQRDDLIASILSEVTPTPLEELRSHKAMVKLRSRQDRDLRELHKKHQRKAVALTRRLLDGLAQARAEGKCRPSSSALSRATNVEDVKEEEKEAARQYREFQNRQVQSLLELREAQADAETERRLEHLKQAQQRLREVVLDAHTTQFKRLKELNEREKKELQKILDRKRNNSISEAKTREKHKKEVELTEINRRHITESVNSIRRLEEAQKQRHERLLAGQQQVLQQLVEEEPKLVAQLTQECQEQRERLPQEIRRCLLGETSEGLGDGPLVACASNGHAAGSGGHQSGADSESQEENTQL

SEQ ID NO: 23690 - protein, 261 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 23691 - protein, 314 aa, Medicago truncatula
SSPKKEVEGDSITVLNWLELPRDIIATNILQRLSITEIITSACLVCPLWWNICKDPLMWRIINLTILDTSSKDLKKIVDYALERSCGNLEEINIECLCSDGLLKYIANRASNLRRIRLKRPSLYKRFCEVVKKLSLLEEVDVSLSCISKDSLKSIGRGCPLLKLLKFKKKCCEDIKCDEDAFAIANTMPKLRLLMIFGNSLTNVGLLSILDACPLLEDLDLRECLNLDLSGRLGKRCQDQIIYLRLSNYDVDDTCYDHDNSCQQSQRKMYTHSDLTVWLSYAELPNTPTRYYDVDDNDNDNDYYCPSLKKKKKK

SEQ ID NO: 23692 - protein, 518 aa, Schizophyllum commune
MRVSLIIALVYVPISLALGPVGNLPIVNKEIAPDGFSRPTVLANGKFPGELIKGTKGNTFKINVQDQLNDTRMLRSTTIHWHGFFQKNSNWADGPAGVTQCPIATGDSFVYEFGVPDQAGTFWYHSHLSTQYCDGLRGAMVVYDPADPHRSRYDVDDDNTVITLADWYHALAPTIIGVGTPDSTLINGKGRYNGGSLTNLTRINVVRGLRYRLRIVSLSCDPSFTFAIHGHNMTIIEADGVNTQPLVVDSLEVFAGQRYSVVVHANQRIGNYWIRANPSFGTIGFAGGLNSAVLHYIGASSSEPAEVDTEPVSSSPFVETALRPLENPGAPGLPQQGGADVNINLAIDLTLDPFQFTVNGAPFIPPSLPVLLQVMSGARTAQELLPEGSVYTLPPNQTVEISIPGGSAGAPHPFHLHGHTFDVVRSAGSTDYNYANPIRRDVVNTGLAGDNTTIRFRTDNSGPWILHCHIDWHLDIGLAVVMAEDTDGMAQSVQPTAYSDLCPKYDALSDEELGGLVD

SEQ ID NO: 23693 - protein, 354 aa, Podospora anserina
MGSCMSTSGEESEQRKRSNKIDRDLEEDSKRLRRECKILLLGSGESGKSTIVKQMKIIHLKGYSHEELKNYRPTVFKNLLECAKSVASAMRQFDIEPVLDENKRHLDFLIDYSLDTNPQTIDAKVSVAIQSLWNDPAKEQLMERQTEFYLMDSAEYFFDEAARIAHKEYIPNEMDVLRARTKTTGIYETRFKMGQLSIHMFDVGGQRSERKKWIHCFENVTSIIFCVALSEYDQVLLEESSQNRMMESLLLFDSVVNSRWFMRTSIILFLNKVDIFKQKLGRSPLSNYFPDYSGGNDVNKAAKYLLWRFNQVNRAHLNLYPHLTQATDTSNIRLVFAAVKETILNNALKDSGIL

SEQ ID NO: 23694 - protein, 377 aa, Danio rerio
METEGKVIKCKVAVAWEPGKPLSIEKVEVAPPKAHEVRIKIAASGVCHSDWAYLYDIAKMKPRPFPLVLGHEGAGVVESVGPGVTKVSIGDKVIPLFLPQCGQCERCQSPKTNLCTKNWEKTQQGVLADGTSRITCKNQQVHQFIGISTFSEYTVVPEDNVTKIHPDAPLDRVCLLGCGVSTGYGAAVNTGKVESGSTCAVFGLGAVGLAAVMGCKAAGASRIIAVDINSDKFEIGKTFGATEFVNHKDHSKSIQEVLRELTNGGVDYALECVGDVAVMRAAVEACSPAGGVCVIVGWIEVEELSLAPLDILLGRTLKGTYFGGWKSVEAVPRLVQDYISRKILLDEFVTHRLALDQINQAFDLIVSGKSIRTVIEM

SEQ ID NO: 23695 - protein, 261 aa, Danio rerio
MAEPELLLDSNIRLWVVLPIVFITFLVGVIRHYVSILLQSDKKLTLEQVSDSQVLIRSRVLRENGKYIPKQSFLMRKFYFNNQEDGFFKKTKRKVVPPSPMTDPSMLTDMMKGNVTNVLPMILIGGWINWTFSGFVTTKVPFPLTLRFKPMLQQGIELLSLDASWVSSASWYFLNVFGLRSMYSLILGQDNGADQSRIMQEQMSGAAMAMPADTNKAFKAEWEALELTDHQWALENVEEDLMSKDLDLSGMFSKDLPTGIF

SEQ ID NO: 23696 - protein, 343 aa, Xenopus laevis
MEVNSAPPEGGVKTNAEDMTSKDYYFDSYAHFGIHEEMLKDEVRTLTYRNSMFHNRHLFKDKVVLDVGSGTGILCMFAAKAGAKKVIGIECSSISDYAIKIVKANKLDHVVTIIKGKVEEVELPVEKVDIIISEWMGYCLFYESMLNTVIYARDKWLTPDGLIFPDRATLYITAIEDRQYKDYKIHWWENVYGFDMSCIKDVAIKEPLVDVVDPKQLVSNACLIKEVDIYTVKVDDLSFTSPFCLQVKRNDYIHALVAYFNIEFTRCHKRTGFSTSPESPYTHWKQTVFYMEDYLTVKTGEEIFGTIGMKPNAKNNRDLDFTFDIDFKGQLCELSCSTDYRMR

SEQ ID NO: 23697 - protein, 682 aa, Xenopus laevis
MFIVVNEFCERFSYYGMKAVLTLYFLNYLHWDENLSTTVYHAFSGLCYFTPLIGAPIADAWLGKFNTIFYLSILYVIGHIIKSVGAIPTVGSTEVHVALSVIGLIAIAFGTGGIKPCVAAFGGDQFEEEHAQERSKFFSIFYLSINAGSLISTFVTPVLRGDVQCFGGDCYALAFGVPAALMFVALIVFVAGSGMYKKYPPQGNILASVFGCIGFALKNRWRHRSKQHPKREHWLDWADEKYQKRLITEVKMVTKVLFLYIPLPMFWALFDQQGSRWTLQATRMNSDFGGFVLQPDQIQILNPLLILILIPVFDLGIYPLIRCCKIDFKAIPKMAIGMILAALAFAVATVVEIKINETLPPVSAAKESYLQVLNLARGELIVEIPGLETIRQPSLHDTNPVDPDYIKLDLLNAHNDFNVELTQGTVKSECKLHIEEKSSFSLLVYSEENSLNCSLIEESQTKPANGLAMVRFINMLSDEANVTIGDSTVSARRGDVSNYVTLKRGKITASCLTELNTYELDLGLLNFGATYTVILLMGNDGNIELKKTEDVTANSFHVAWQVPQYVLLSAGEVMFSVTGLEFSYSQAPTSMKSVLQAGWLFTIAIGNVIVLIVAQAGTLEQWAEFILFAALLVAVCIIFSIMGYFYVPANPDDLKDDEELEKKQLPDDNLNAIPMEEKKTKM

SEQ ID NO: 23698 - protein, 718 aa, Danio rerio
MADKEGHKQKKERASCFGYPVSIFFIVVNEFCERFSYYGMKAVLVLYFKYFIGWDDDLSTTIYHTFVALCYLTPIMGAIIADSWLGKFKTIVYLSIVYTIGQVIMAISAIHDITDANRDGKPDNKTLHISLSMLGLILIALGTGGIKPCVAAFGGDQFEDHQEKQRSTFFSIFYLSINAGSLLSTLITPILRSQECGIYAKQSCYPLAFGVPAALMVVALIVFVIGHKMYIMESPKGNILLQVINCIGFALNNRFRHRGKQYPKREHWMDWAEEKYDKLLIAQVKMVVKVLFLYIPLPMFWALFDQQGSRWTIQATTMDGNFGGFVIQPDQMQIVNPILIVIMVPIMDSAIYPLIKLCRINFTPLRKMTVGMVLAALAFVAAALLQLQIDETMPKFPSTSQTQLKFLNVESTSLPVVVEGQDQFMVPGFNASSEYLTLDKENVTISAGGVNDTAFLKTGTRHTVLMNAAGMRNTLDDLTEKPEQGLNAIRFVNGWENRLNVSVKSDNVHADPLDASVYLLVPHGKVNFTIFDGGDGKCHYIMQLGFGSTYTVLIPSTFAFGQTCSESFEAVQDMEPNRIHMAWQVIQYFLLTCGEVVYSVTGLDFSYSQAPSNMKSVLQAGWLLTVAVGNIIVLIVAEAGSLPDQWAEYLLFASLLVAVSIIFAIMAYFYTYIDPNEIEAKFKELEPEDKKRKEMQMTAKDNMAYVHNENTNIKQTKI

SEQ ID NO: 23699 - protein, 697 aa, Danio rerio
MDMEEKPKYGEPRKFDPSFKGPIQNRGCTDIVCCIIFIIAILGYLAVGILAWTHGDPRKVIYPTDSMGQFCGQGKLEKQPFLFYFNMMKCASPMVLLEFQCPTPQVCVQTCPNRTMTLITAISKPQDWEYYKSYCKEDPGHKAAAQILKEKLCPAYLVSSNPFLQRCFPSMGKKGEVITVGDQEKFSDGVNVLDAKDLMAGMKNASIVMEGRQVAMKIFEDYTKSWYWILICLLIAVVLSLIFIVLLRFLAGVMVWVMILMVVAVIAYGIAHCSIKYVSLKDTPGSNITLQQLGFQPDFAVYLHIRQTWLAFIIILAILELIIILLLIFLRNRIRVAVELMKEASRAIGYVMSSLVFPIFTFFLLAIVIAFWGVNAVFLSTSSEPVYKVFNETECVHSRETCNPENFTSSSMKSDCPHSQCLFAFYGGETPYHKYLILLQFYNVFLFFWCANFVTALGQMTLAGAFASYYWAFDKSKDMPAFPLCASLGRSLRYHTGSLAFGSLLLAIVQVIRVLLEYIDHKLKGAENKFAKFLLCCLKCCFWCLEKFIKFINRNAYIMVAIYGKNFCRSARDAFFLLMRNVVRVVVLDKVTDFILFLGKLLIVGLVGIFAFFFFSGQTDAFKGTAPSLHYYWVPILTVLVCSYLIAHGFFSVYAMCVDTLFLCFLEDLERNDGSAERPYLMSENLLNVLKKKNQAN

SEQ ID NO: 23700 - protein, 523 aa, Danio rerio
RCSGTTFSSCPTASSSSLQSLSKELLSNSNGMAQFQEVMRQQLESSMHVELEKLLSTAKGAGAEVSKKDFEGFRKLFHRFLQVKGPSVEWPKINRPPEDSIQPYDKIKAKGLPDNIADSLNKLVVVKLNGGLGTSMGCKGPKSLISVRNENTFLDLTVQQIEHLNKTYNADVPLVLMNSFNTDEDTKKILQKYTHHRVKIHTFNQSRYPRINKESLLPVAKDMGITGENGDVWYPPGHGDIYASFYNSGLLEQLIAEGKEYIFVSNIDNLGATVDLYILNHLVSQPNGKRCEFIMEVTDKTRADVKGGTLIQYDGKLRLLEIAQVPKAHVDEFKSVTKFKIFNTNNLWISLSAIKRLQEQNAMDMEIIVNPKTIDGGLNVIQLETAVGAAIKCFDNALGINVPRSRFLPVKTTSDLLLVMSNLYSLDAGSLTMSEKREFPTTPHVKLGSSFTKVQEYITRFESIPDMLELDHLTVSGDVTFGKHVSLKGTVIIIANHGDRIDIPAGSMLENKIVSGNLRILDH

SEQ ID NO: 23701 - protein, 173 aa, Marchantia polymorpha
AHATFYGGDSGAATMGGACGYGNLWWRGYGLATAALSDTLLNNGLTCGACFEIKCNITGGESGKWCIQSNPSIKITATNQCPPNFDRPTDNGGWCNPPRTHFDLSLNMFRRLAQTQAGIIPISYRRTRCIKTGGIRFYLGGNAHFNLVLVYNVGGWGDVMKMQIRGTKTGWIT

SEQ ID NO: 23702 - protein, 401 aa, Chlamydomonas reinhardtii
MASLLGRKACIPATCVQKSLTPPAPLRLGLACSALQRHQVQTAIASRVARQQEENGRAAAIVPRQRTVCQAAAVPADGESDKGKDMSGMMVLGLMFVAWYGTNIFFNIYNKQLFKVFPFPLTTTNIQFFIGSCLSMVFWVTGIVKLPKIDMALVKSIYPLAIINVLGNVLTNVSLGHVAVSFTHTVKAMEPFFSVIFSAIFLGDVPPVPVLLTLVPIVGGVVIASLTEATFNWTGFLSAIFSNMTFQSRNVLSKKLMIKKGAVDNMNLFQIITIMSFLMLLPVSTMVEGGAALLTPESLANLGLNEAAREQMFMRLLSAGICFHSYQQLSYMILSRVAPVTHSIGNCVKRVVVIVASLIAFQNPISMQNAIGTGIALFGVFLYSQAKRKYKGKGDVKPEAA

SEQ ID NO: 23703 - protein, 564 aa, Pseudomonas putida
MPSILTRRTFVKGLAAGSLLGGLGLWRTPVWALNGAAPVNELSGNEFELFIGETPVNFTGSARTAMTINGSLPGPLLRWREGDTVTLRVRNRLTADTSIHWHGILLPANMDGVGSEFHAIEPGGVYVYQFKVRQHGTYWYHSHSGLQEQAGVYGPLVIEAKEPEPFHYDRDYVVMLSDWTDEDPASLMKTLKKQSDYYNFHKRTVGDFINDVSEKGWGATVADRTMWAQMNMNPTDIADVSGATYTFLINGQAPDDNFTWLFRPGEKLRLRLINGSAMTYFDVRIPGLKMTVVAADGLHVKPVSVDELRIAVAETYDVIVEPETEAYTLFAQAMDRSGYARGTVATRAGMSAAVPALDPRPLVSMDDMGMGGMDHGSMDMSAMDHSSMGPMQAHPDSENNNPLVDMQAMVTAPKLDDPGLGLRNNGRRVLTYADLRSTFEDPDGRDPSRTIELHLTGHMEKFAWSFNGIKFSDAEPLRLKYGERIRLVLVNDTMMTHPIHLHGMWSDLEDENGNFQVRKHTIDMPPGSRRSYRVTADALGRWAYHCHLLYHMKRACSAKVRVEE

SEQ ID NO: 23704 - protein, 339 aa, Arabidopsis thaliana
MVCFNFNEMKTKKTLIGLGLGQIISLLSTLIASIASEIARKGISAPTSQTFLGYVSLAIVYGGIMLYRRSAIKVKWYHYFLLAVVDVEANFLVVKAFQNTSMTSIMLLDCWAIPCVLVLTWVFLKTRYRLMKISGVVICIVGVVMVVFSDVHAGDRAGGSNPVKGDFLVIAGATLYAVSNVTEEFLVKNADVTELMAFLGLFGAIIAAIQISIFERGAVRAIQWSTEAILLYIGGALGLFLFYTLITILIKNNGSTMFNLSLLTSDMWAVLIRTFGYHEKVDWLYFLAFATTATGLIIYSMKEKDEEEQRSGEVVSERRKLFDEEDGDSLHSNLIDAST

SEQ ID NO: 23705 - protein, 645 aa, Arabidopsis thaliana
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 23706 - protein, 2548 aa, Homo sapiens [sequence omitted]

SEQ ID NO: 23707 - protein, 415 aa, Tradescantia virginiana
TTPISIEDVRREVKILKALSGHKHLVKFYDACEESLNVYLIMELCEGGELLDRILSRGGKYTEEDAKAIVMQILNVVAYCHLQGVVHRDLKPENFLFINRDENAPMKLIDFGLSDFTRPDERLNDIVGSAYYVAPEVLHRSYSMEADIWSIGVITYILLCGSRPFWARTESGIFRSVLRADPNFDDSPWPTASPEAKDFVKRLLNKDYRKRMTAAQALSHPWLRDKEPQIPLDILIYKQTKLYLRATPLKRAALKALSKALTEDELVYLRLQFKLLEPNNDGRVSLENFHTALAQNATEAMKESRVLDILNSLESLAYRRMDFEEFCAAAISCYQLEALEHWEQIASTAFEYFEQDGNRVVSVEELAQDLNLPQNAYAILKDWIRQSDKKLSFLGYTRYTRYLHGVTPRPNTRQH

SEQ ID NO: 23708 - protein, 337 aa, Xenopus laevis
MNEQNKRKGMELVPVLAKKPRNELVVSGPPRSSSLQAPIMLLSGHEGEVYCCKFHPNGVTLSSAGFDRLILLWNVYGDCDNYATLKGHSGAVMELHYNTDGSLLFSASTDRTVAIWDCETGERVKRLKGHTSFVNSCYPARRGPQLICTGSDDGTVKLWDFRKKAAVQTFQNTYQVLSVTFNDTSDQIISGGIDNDIKVWDLRQNKLMYTMRGHGDSVTGLSLSSEGSYLLSNAMDNTVRVWDVRPFAPKERCVKIFQGNVHNFEKNLLRSSWSADGSKIAAGSADRFVYVWDTTSRRVLYKLPGHAGSVNEVAFHPEEPIILSASNDKRLYLGEIQ

SEQ ID NO: 23709 - protein, 242 aa, Schistosoma mansoni
MVLCKIMMWTIKQVISNRDHPLREQDRFLPIANVAKIMKRAVPGNGKIAKDAKECVQECVSEFISFITSELPDKCQTEKRKTINGEDILCAMNTLGFDNYIEPLRAFLVKFREISKLESSFIDESSVPTTMSTVPPAVGSAVILSPTLLSTGPSGLTNIPSRSLAGRQYAVVNGSNDIQNNNVHSVSTPDIKVANAGMTTLGTPVSSSLGTTIILPISTPLAFVSGPQTSVSLADQSTDSVS

SEQ ID NO: 23710 - protein, 101 aa, Paracentrotus lividus
GRGKGGKGLGKGGAKRHRKVLRDNIQGITKPAIRRLARRGGVKRISGLIYEETRGVLKVFLENVIRDAVTYCEHAKRKTVTAMDVVYALKRQGRTLYGFGG

SEQ ID NO: 23711 - protein, 325 aa, Emericella nidulans
MSSGKTFKLSNGVTIPAVGFGTFASEGASGETYRAVKKALEVGYRHLDCAWFYQNEDEVGDAVRDFLKENPSVKREDIFICTKVWNHLHRPEDVRWSIEDSLKKLKTDYVDLFLIHWPIAAEKESQDKPKIGPDGKYVILKDLTEDPKPTWQAMEKLYEDKLARSIGVSNWTIEGLEKLLKYAKVKPHVNQIEIHPFLPNEELIQYCWKNDILPEAYSPLGSQNQVPTTGERVSENKTLNEIAQKGGNTLAQVLIAWGLRRGYVVLPKSSNPARIESNFKTIELSDEDYEAVNAVAKGRHFRFVNMKDTFGYDVWPEETAKNISA

SEQ ID NO: 23712 - protein, 320 aa, Homo sapiens
LLKKLHSCQMSIQLLQTTRIGVAVNGVRKHCSDKEVVSLAKVLIKNWKRLLDSPGPPKGEKGEEREKAKKKEKGLECSDWKPEAGLSPPRKKREDPKTRRDSVDSKSSASSSPKRPSVERSNSSKSKAESPKTPSSPLTPTFASSMCLLAPCYLTGDSVRDKCVEMLSAALKADDDYKDYGVNCDKMASEIEDHIYQELKSTDMKYRNRVRSRISNLKDPRNPGLRRNVLSGAISAGLIAKMTAEEMASDELRELRNAMTQEAIREHQMAKTGGTTTDLFQCSKCKKKNCTYNQVQTRSADEPMTTFVLCNECGNRWKFC

SEQ ID NO: 23713 - protein, 337 aa, Sus scrofa
TDQAAFDTNIVTLTRFVMEEGRKARGTGEMTQLLNSLCTAVKAISTAVRKAGIAHLYGIAGSTNVTGDQVKKLDVLSNDLVINVLKSSFATCVLVSEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRDVKIKKKGSIYSINEGYAKEFDPAITEYIQRKKFPPDNSAPYGARYVGSMVADVHRTLVYGGIFMYPANKKSPKGKLRLLYECNPMAYVMEKAGGLGTIGKEAVLDIVPTDIHQRAPIILGSPEDVTELLEIYQKHAAK

SEQ ID NO: 23714 - protein, 374 aa, Homo sapiens
MARSLTWRCCPWCLTEDEKAAARVDQEINRILLEQKKQDRGELKLLLLGPGESGKSTFIKQMRIIHGAGYSEEERKGFRPLVYQNIFVSMRAMIEAMERLQIPFSRPESKHHASLVMSQDPYKVTTFEKRYAAAMQWLWRDAGIRAYYERRREFHLLDSAVYYLSHLERITEEGYVPTAQDVLRSRMPTTGINEYCFSVQKTNLRIVDVGGQKSERKKWIHCFENVIALIYLASLSEYDQCLEENNQENRMKESLALFGTILELPWFKSTSVILFLNKTDILEEKIPTSHLATYFPSFQGPKQDAEAAKRFILDMYTRMYTGCVDGPEGSKKGARSRRLFSHYTCATDTQNIRKVFKDVRDSVLARYLDEINLL

SEQ ID NO: 23715 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDTEAEAIELANSLPYGLASAIWTENASRAHRVAGQIEAGIVWVNSWFLRDLRTAFGGSKQSGIGREGGVHSLEFYTELKNICVKL

SEQ ID NO: 23716 - protein, 337 aa, Homo sapiens
ADQAPFDTDVNTLTRFVMEEGRKARGTGELTQLLNSLCTAVKAISSAVRKAGIAHLYGIAGSTNVTGDQVKKLDVLSNDLVMNMLKSSFATCVLVSEEDKHAIIVEPEKRGKYVVCFDPLDGSSNIDCLVSVGTIFGIYRKKSTDEPSEKDALQPGRNLVAAGYALYGSATMLVLAMDCGVNCFMLDPAIGEFILVDKDVKIKKKGKIYSLNEAYAKDFDPAVTEYIQRKKFPPDNSAPYGARYVGSMVADVHRTLVYGGIFLYPANKKSPNGKLRLLYECNPMAYVMEKAGGMATTGKEAVLDVIPTDIHQRAPVILGSPDDVLEFLKVYEKHSGQ

SEQ ID NO: 23717 - protein, 161 aa, Cichorium intybus x Cichorium endivia
MGFSEKQEALVKESWEVMKQDIPALSLYLYAMILEIAPEARGLFSFLKDTNVIPQNNPKLKSHAVKVFKMVCESAIQLREKGEVVVSGSTLKYLGSVHLEKGIVDPQFEVVKEALIRTVAKAMGEKCSEEMKSAWSEAYDELADAIKTEMKKEAAETQTHI

SEQ ID NO: 23718 - protein, 456 aa, Vibrio parahaemolyticus
MHRYKEEASSLIKLATPVLIASVAQTGMGFVDTVMAGGVTQTDMAAVSVASSIWLPSILFGIGLLMALVPVVAQLNGSARREKIPFEIQQGVVLALLISIPIIGVLLQTQFILQLMDVEAVMADKTVGYIHAVIFAVPAFLLFQTLRSFTDGMSLTKPAMVIGFIGLLLNIPLNWIFVYGKFGAPELGGVGCGVATTIVYWVMFALLLAYVMTSSRLKSINVFGEYHKPQWKAQVRLFKLGFPVAAALFFEVTLFAVVALLVSPLGPIIVAAHQVAINFSSLVFMLPMSVGAAVSIRVGHRLGEENVDGARVASRVGIMVGLALATITAIITVLSRELIAELYTNNPEVITLAMQLLLFAAVYQCTDAVQVIAAGALRGYKDMRAIFNRTFIAYWILGLPTGYILGRTDWIVEPMGAQGFWLGFIIGLTAAALMLGVRLRWMHRQEPDVQLNFSLQ

SEQ ID NO: 23719 - protein, 771 aa, Oryza sativa
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIVLVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 23720 - protein, 259 aa, Listeria monocytogenes
MPKVSQPDKEAKEKVYIWIAAYQENGDQDAQYNLVVHYKNLVESIARKYSQGKSFHEDLVQVGNIGLLGAIRRYDATFGKSFEAFAVPTIVGEIKRFLRDKTWSVHVPRRIKELGPKIKNAVEELTRELQSSPQISDIADFIGVTEEEVLEAMEMGKSYQALSVDHSIEADSDGSTITLLDVVGGTDDGFERVNQRMLLEKVLPVLDEREQKILQFTFIENRSQKETGELLDISQMHVSRIQRQAIKKLREALQNEEVE

SEQ ID NO: 23721 - protein, 264 aa, Oryza sativa (japonica cultivar-group)
MSEENRRLTEVIARLYGGQIPRLGLDGSASPPRPVSPLSGKKRSRESMETANSCDANSNRHQGGDADHAESFAADDGTCRRIKVSRVCRRIDPSDTSLVVKDGYQWRKYGQKVTRDNPSPRAYFRCAFAPSCPVKKKVQRSAEDSSLLVATYEGEHNHPHPSPRAGELRRRRGGPVASFRAPFPLNFLGPDHSRLDLHQERGTRCTWFKGGHPPPPPDLKKVCRKVASPDFRTALVEQMASALTSDPKFTGALAAAILHKLPEF

SEQ ID NO: 23722 - protein, 1243 aa, Hypocrea jecorina
MMRRPPSQGRWSASHQKLLLAFAFILIPWLQLADAQQQPQQPQIRIHSQRGDAPLDKVADDANTRWYATHAAPDVHPEAKFDTVNRKQKQQSTASPQQHQKYRRAPYDYASKDKAQNRYAQHPIRESEKPNYVKVPNDASALATLAPAQPVRAPHTSRHHWPSSSAASGLASPQNARSLEDWEVEDFVLLATVDGDLYASDRKTGRHLWHLEVDQPVVETKHYRTNNSVLDDDYRPVDHYIWAVEPSRDGGLYVWIPDSGAGLVRTGFTMKHLVEELAPYAGDEPPVVYTGDKKTTMVTLDAATGRVLKWFGSSGSQVNEAESCLRPNAFDDRDTTECSSMGTITLGRTEYTVGIQRRDGRPIATLKYAEWGPNTFDSDLYQQYHASLDNHYITSQHDGRIYAFDKSQAENDLPLYTHKFSSPVARVFDVCRPWDANAGSNPELVVLPQPPIPALDESTVKMRSNSIFLNQTESGDWYALSGRAYPLILDAPVAQISRDDLWDMAHAFDSINPNKLSKALVGTHFLNPVKSTGYHQPPTLPAGALDEYYEDLENASNNAHAVTNTVPEEPTIITKVKALPQSAANSVIDFVSNPILIIFLIGSLIYNEKKLRRSYHRFRTHGTIKDVYPFFVIESEAGDESGDDKDGVFPSSPSPRSQPQDQNAEDHLSRHKVERNAGDQDKVKDNRSLHDVSDTLEPSNKTVEKTADVVKQVDVAGPDAPSTDSNGAAPEKKKKAHRGRRGGVKHRKGRPTDGSQSHENDPALTTVDEAVSNAKKLGDRPSLEPDVMTIYNDMQAVTGSVISMGNIEVDTDVELGMGSNGTVVFAGRFDGRDVAVKRMTIQFYDIATRETKLLRESDDHPNVIRYYSQVQRGDFLYIALERCAASLADVIEKPYAFGELAKAGQKDLPGVLYQITNGISHLHSLRIVHRDLKPQNILVNLDKDGRPRLLVSDFGLCKKLEDRQSSFGATTGRAAGTSGWRAPELLLDDDGQNPAAIDSSTHSGSHTILVGDPNSLSNGGRATRAIDIFSLGLVFFYVLTNGSHPFDCGDRYMREVNIRKGNYNLDPLDALGDFAYEAKDLIASMLQASPKARPDSREVMAHPFFWSPKKRLAFLCDVSDSLEKEVRDPPSPALVELERHAPEVIKGDFLKVLTRDFVESLGKQRKYTGNKLLDLLRALRNKRNHYEDMSDSLKRSVGSLPDGYLAYWTVKFPMLLLTCWNVVYNLEWEKTDRFREYYEPAGL

SEQ ID NO: 23723 - protein, 319 aa, Metarhizium anisopliae
EQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPTPEEFFDFDKHKDN

SEQ ID NO: 23724 - protein, 340 aa, Cordyceps bassiana
MSRANPPNNASASRKISFNVSEQYDIQDVVGEGAYGVVCSAIHKPSGQKVAIKKITPFDHSMFCLRTLREMKLLRYFNHENIISILDIQKPRGFDSFNEVYLIQELMETDMHRVIRTQVLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVLFRTLFADTSDLALDLLEKLLAFNPVKRITVEEALKHPYLEPYHDPEDEPTAPPIPEEFFDFDKHKDN

SEQ ID NO: 23725 - protein, 914 aa, Magnaporthe grisea
MDGHSNFTQPSDTSHASHTIPSSSSSQRRRLTKKPPPSTSARHHHSSLSIDSRVDAQSLVGKRSSTSLRRAPSAPPARTPTSTHASNSSSPRNPSSSTRLNNHSPIIPAASEFAASSLSPSARDRDSDPARNDHGHQLQNNNNYYYSAFTNAHHHNQYSAASHRRSNSYGHPHGPQSSNSLTFNHSEDFIGAPFDGSAILNRIEATKASPTLGSGAFPHISNPIPVGAAAPAQYSRGSPALEQSFTFPSAAMREKSQQVRGMEAQLPTSKRYSDETKEPKPGVLRKKSGFSGFMSGLVGTPKKPLISAPENPVHVTHVGYDSATGQFTGLPKEWQRLISESGITEKERRENPETLVNVIKFYKETTEKPAEDQVLEKFHDARPGLPSAPSAGSMISPGLAPHHYNPMSPMISPPASPRFPQVGHEGNFENPRSPPPVPKNKDVTLMPSRPAPRPPVSLPTRTAPHAPYAAKDSGIDMPPQHDDLTPTTYQPPKESQPILPEEHRSRSNSRVNGNTAYPASQQSPAVQAAYQQQLMQQQQEQALAQAQASMSGSMSRAPSKRQPQAQQPTPPQSQHQYSRPTDANGAQQTQRPQQPQIGPVPQSRPRHRSRQSNGLDVVAALKRICSEGDPREIYRSFTKIGQGASGGVYTGHERGSNRLVAIKQMNLEQQPKKDLIINEILVMKDSSHPNIVNFIDSYLCGGELWVVMEFMEGGSLTDVVTFNIMTEGQIASVCRETLLGLQHLHSKGVIHRDIKSDNILLSMEGNIKLTDFGFCATINEAQNKRTTMVGTPYWMAPEVVTRKEYGRKVDIWSLGIMAIEMIEGEPPYLTESPLRALWLIATNGTPQIKDEGNMSPVFRDFLYFALKVDPDKRASAHDLLRHEFMNLCVDLSHLSPLVRAAREARAQEKARKGQ

SEQ ID NO: 23726 - protein, 403 aa, Sinorhizobium meliloti
MLTQKTKDIVKATAPVLAQHGYAIIQHFYKRMFQAHPELKDIFNMAHQERGEQQQALARAVYAYAANIENPESLSAVLKDIAHKHASIGVRPEQYPIVGEHLLASIKEVLGDAATDEIISAWAQAYGNLADILAGMESELYGRSEERAGGWAGWRRFIVREKNPESDVITSFVLEPADGGPVADFEPGQYTSVAVQVPKLGYQQIRQYSLSDSPNGRSYRISVKREDGGLGTPGYVSSLLHDEINVGDEPKLAAPYGNFYIDVSATTPIVLISGGVGLTPMVSMLKKALQTPPRKVVFVHGARNSAVHAMRDRLKEASRTYPDFKLFIFYDEPLPTDIEGRDYDFAGLVDVENVKDSILLDDADYYICGPVPFMRMQHDKLLGLGITEARIHYEVFGPDLFAE

SEQ ID NO: 23727 - protein, 217 aa, Brassica napus
MARGKIQIKRIENQTNRQVTYSKRRNGLFKKAHELTVLCDARVSIIMFSSSNKLHEFISPNTTTKEIIDLYQTVSDVDVWSAHYERMQETKRKLLETNRKLRTQIKQRLGECLDELDIQELRSLEEEMENTFKLVRERKFKSLGNQIETTKKKELRAEDPHYGLVDKGGDYDSVLGYQIEGSRAYALRYHQNHHHHYPNHTLHAPSASDIITFHLLE

SEQ ID NO: 23728 - protein, 224 aa, Brassica napus
MARGKIQIKRIETQTNRQVTYSKRRNGLFKKAHELTVLCDARVSIIMFSSSNKLHEFISPNTTTKEILDLYQTVSDVDVWSAHYERMQETKRKLLETNRNLRTQIKQRLGECLDEFDIQELRSLEEEMENTFKLVRERKFKSLGNQIETTKKKNKSQQDIQKNLIHELELRAEDPHYGLVDNGGDYDSVLGYQLRFHQNHHHHYPNHALHEASASDIITFHLLE

SEQ ID NO: 23729 - protein, 224 aa, Brassica napus
MARGKIQIKRIENQTNRQVTYSKRRNGLFKKAHELTVLCDARVSIIMFSSSNKLHEFISPNTTTKEILDLYQTVSDVDVWSAHYERMQETKRKLLETNRNLRTQIKQRLGECLDEFDIQELRSLEEEMENTFKLVRERKFKSLGNQIETTKKKNKSQQDIQKNLIHELELRAEDPHYGLVDNGGDYDSVLGYQLRFHQNHHHHYPNHALHEASASDIITFHLLE

SEQ ID NO: 23730 - protein, 227 aa, Oryza sativa (japonica cultivar-group)
MGRGKIAIKRIDNTMNRQVTFSKRRGGLMKKARELAILCDADVGLIVFSCTGRLYDFSSSSMKSIIERYQEAGEEHCRLLNPMSEAKFWQREVTTLRQQVQNLHHNNRQLLGEEISNFTVRDLQLLQNQVEMSLHSIRNKKDQLLAEEILKLNEKGSLVQKENSELRKKFNIAHQRNIELHKKLNSGESTSSEQVTRSSKDPGESSTPRDSRVCIDLELSQKEVEDE

SEQ ID NO: 23731 - protein, 275 aa, Antirrhinum majus
CENWGFFELVNHGITPEFMDTVEKLTKEHYKKTMEQRFKEMVASKGLEAVQSEINYLDWESTFFLRHLPVSNISEVPDLEDQYRKVMKEFALQLEKLAEELLDLLCENLGLEKGYLKKAFYGSKGPTFGTKVSNYPPCPKPNLIKGLRAHTDAGGIILLFQDDKVSGLQLLKHGEWVDVPPMRHSIVINIGDQLEVITNGKYKSVMHRVIAQTDGNRMSLASFYNPGSDAVIYPAPALVEKEETKDLYPKFVFEDYMKLYTTVKFQAKEPRFEAM

SEQ ID NO: 23732 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGALFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSENGPATSNLLPNVRENFNARKTFRTAYNAVRAFNTWKKLENKH

SEQ ID NO: 23733 - protein, 4498 aa, Takifugu rubripes
MAHSCRWRFPARPGGSSNSGTGRRAGRIRVTASLRSVPGAHPNAAGLGPGFDAALQVSSVIESNLQKFRDVLGESSDSSSAEEEAFGGFRTVAEQKRIQSPSTTCSETPSPQEKKPRGRPPRVLTAHKSAPSLPSHTSLPSSTQSKPEGPERPAEKIKRLPGRPPGTGEKRRGRPPSSSSKKSWSTTVADDSRQDGSEDGVDTDEDRKSAKRAPFGPSQPNDNEAQLPKGGRGDAKVSNLKRLRATKLSPLKSRLKTLPGVPRRRRGRPPSAERLKAEAAAAAGAAHLSAAIESGEGKHKAFKARMGEQLSMPRSVDDIEDQDSCNSAASPASSKPGRTMGLRKSPRHRKPVRIVPSSKRTDATIAKQLLQRAKKGAQKRLEKEAVASGSRGTGAIEAGIRKTQLKNIRQFIMPVVSTVSLRIIKTPKRFIEDEGSFGTPTPHLKMARLETATSAVSASSQPTASSSPAPAQVSSALNVTAGNSGAPTDNLPPPPPPAPSPSVQSTTPSLLNTNANNATNGRFSSSAASCGSSAVSQHSSQLSSAESSRSSSPSLDDSSCDSQASEATQALSETEDHSPSLQGERKGNLLHSAKLPSPPSEPEPEHVLQERNRRGRRGQGVSRESPNQRPRETLAPVAKKPIISPPTGVLMSSTFVNSQQASSTASSSSSPPPPPLLTPPQLPQSASSSTAAIAEHHPQSTWMSHPVPPFMPGSSVLSGLSDKRNRSILRQPTFRWTSLSHPEHQYFSSAKYAKEGLIRKPIFDNFRPPPLTAEDVGLSRQGVSGAGGTPTVPFPAPSSAAGTGNRLFAPLHSHTHHQHPSSSRFDAPVQKRSPLLRPPRFTPSEAHSRIFESVTLHSSSGSSPGSLSPHQTSPNSNRISRRRRQLGSGTPRGHLRSPSHSMTRRSSQIGGQLSVGKGSSDTSVLTGSVSTSNPSSLQGVSSIPLATSALNPAPFSTFSNVSLSLASQGTTDSRRGTAGNPPPSSNTSSSSSPLFQNFPPSAQDTVRGAGKGAKDKSVSISQEPSPKEKERDSEKNREKEKENKREGRKDSEKKSKIPSPDGSPTAPSSLFTVDGRDTEDPILTLASKKAPGRKKSISVDLVSDTAPSEVRGLHSIGPLSIAKGCLFKKGRPSDKGAEIEDGEKEKEKQSAANQQTASLPGQPGRQQLPVSSLGSVLAQAEKQPVSNKRVVGLLKKANAQLCEINKSKLKPTDQTKVQGQESDSSETSVRGPRIKHVCRRAAVALGRNRAVFPDDMPTLSALPWEEREKILSSMGNDDKSSVAGSEEAEPQSPPIKPRETRQKAIQEAPPKKGRRSRRCGQCSGCQVPEDCGVCTNCLDKPKFGGRNIKKQCCKMRKCQNLQWMPSKIFQKQEKGKKDKKKKLSEKKEGLNPVKIPASDSGQKSSPPLQKEDPHRKKSESPPLKSAEDKLKLQSASKQPSPGLDSSPAPDEPSQAPSAVTAQSPSPPLTADKKGHKPQQSAPTSSSSSSSSSSSSSSSSSSSSSSSSSSSSPSSSAQNSPSQATQSHAPSQQQQRPVNSQASSKKDASPKIPLSETKRKPQQHSAQQQSSSALSDTTDLKQLKKTHSCSVPPSPKQRPKDKPLMAKPSGSSTLNWVNTPSTGSQGRSRAPFDGVHRIRVDFKRDHDVEKVWEAGGLGLLTSVPVTPRVLCFLCASSGNVEFVFCQVCCEPFHLFCLGESERPLQEQFENWCCRRCRFCQACGRQHQKTKQQLLECDKCRNSYHPECLGPNHPTRPTKKKRVWVCNKCVRCKCCGATKPGKSWDAQWSHDFSMCHDCAKLFAKRNICVLCNKCYEDDEADGKMVECGRCHHRVHAKCEKLTDDMYELLSKLPESVAYTCTKCTERHPAEWRTALERQLQGCVHHVLTALLNSRTSSHLLRYKQMVKPPELNPETEESLPSCQQLEGPDPPVLTEVSTTPPSEFPPDLESVKKKTDQGRYSSLEFSDDIVRIIQTAMNGDGGHPESRKANSMVKAFFIRQMERIFPWFKVKESRFWEKQNVSANGLLPNAVLPPSLDHNYAQWQERQELSRAEHSHLMKKIIPAPQPKTPWEPDSPASPPPLPPPPLLPPPPLIPDQEDGPDFPPPPGITDNRQCLLCQKYGDENTNEGGRLLYIGQNEWTHINCALWSSEVFEDDEGSLKNVHTAVLRGKQLHCQKCQLPGATVSCCLTSCTSNYHFMCARHCHCVFLEDKKVYCPKHRDLIKGEVVSEFEVTRRVLVDLEGISLRRKWLSGLEPENVHMMIGSMTIDCLGILTELSDCKRKLFPIGYQCSRVYWSTLDARKRCVYTCRILVCHPTLLESDLKNVMSPEENRTIAHSPPPMTDFPDPFESPRRSDSLSPNNTPKLRVYTRNRHPSYPPCHHSLGPSPIPSLGGNTQPQSQENVTPGEFPANPSIQNINARRNSSAPLSPPLHQLNRQRGVTSLPQILSRPLTSPPPLIPSPARDPEKSKHLSKEVAKSQTLRDDERGRPFSTDRNRQKSSRDQEFRDVDKGQVSSQDQAIKDSEKNPSSRELQKESDKCEVSGREPEKRTSLGKDLDHKESERGKLVSRDQVRDSEKRRQMIRGSDKGRHGSRDPIHRESNKSKSFSREPSNKDMEKSRSLSKEAGLKESDKHKQYSKETGKDSGQGKDRLSSRDTDKGRPSSRDFSQRSTERNKDSGSGKDRNTGTQFKQAGDEAKNPGLVPASSGQYSPPVGTAALTGQQRVGGTKQTDKQGKHGGKDQDDSMSPTSMPRHRLNSYSSQSTGNVMQASFHKDSVIGKTGSLSSIQKSSARKSNDYLPGPVTAAAMKPLWPSWTPAEEDVVKQGSMHLASPAASLAKEKQPKVKTAGSREVSKDHEREKTLQNNSKIPLLNNNTKATGSFTTNATNTSSNNGSNSRVAVLGNSIEAHGNAQGEKLENQGGDRSSSKNRENYHSSERKNSSGADNMHQSSSAPEKEVKTDSESHHKATTNQLPLSSRDKRKFVSFPSVTTLKAEMKLDPNGTGTVGGISSSSNVTPTSTISPASQGTCRSALATLYSPSVSSSDSSESDTQPPIDEDVHTKHLHIKHRDHHSLLSHAAEDEGDGPEDDNDRAMDGKHHEDDSDGSGSAKRRYPRRSARARSNMFFGLTPFYGVRSYGEEDLPFYGSGDGAGAIVKRRTGIRKKSAEGQVDGADDISSTSSSGDSGEDEDDEMKQSGKDPFYYSFTRTIINPGDGLPSIEGIDQCVGRGSQLQRFLKDEAQQQQRAQGKTEEDLLNALTLGKPQIGQLDGVDDGSESDASTSTTTTTTTSSSTPNKSTPKRRGRDRHVEKPDPHDLSKDADNSGGAVSSNTREGRKNQKENCLPLGGAVKSQSQGQDPLETQLSLSSDLLKSDSDNNNSDDCGNILPSDIMEFVLNTPSMSMQALSQQSEPSSSELLLDEGYVDVNRRKNMLFDDFSQPLSNAESGSVVESNVNSSMSVEEPYLPLELPSDLSVLTTRSPTVSTSQNHTAGSLIPDSSDRNMLALTPNSEVISGDKSGDKKRAAVLQSENQHDASTLGNKNTQVTEGHMTPEHFIPSSAIGQVVEPSGNQDVNRSSGTPGLPSSPSLPQKYLQTSTVAAGSPSPVSGPSQTQVTSPAVIKPGPDKLILVNQQFQPLYVLQTVPNGVTQKLSATGVMDNSSQAVLSSMTLATGLNTGLSTAQPIFPAGGKVLGTMAHPSQIHTFTGTTQTGFQTGIPSTTSGLLIGLPHDQSQILVSEAGRPQDLRPSVAIVSSSPSLTSSPAALASAHGKKRPISRLQPRKTKKLARTRSQPALAPSEVNPPNMTLINLSSPQITASIPGQPGGLVELSTISTSQRKVPNIIKRPKSGVMYLDPTTLIQQRIPGPAQSGVLGHDSSSHAHLLPCTVSGLNPSQSVVNVVSVPPNGAAGLLAPGSVSLSTPVLGSTEITGSISNLLFKASPHGLGLSDQPMVLQSAGGAPLMSQLTSSVQTSLSSSICVLPSQQTISMTVNQQAEIEGNNLHLQHQSQPLNRAQTLDSGPNSAVTLAPSSATPLSPTKGCVVGVFTQTSALSQSNRTAPISRSSDPRPAKTNTTVTVLGAEKGKQKTKRSRQSANFTSGKKLKVSQEEEHHSHHAGRAQSNSSSKDLSSLEPMDTGKPAEKTTNKGVLGKKKTSEGHVLPANILGNEKGCVAEGAGSLPVASPPDQENSSDLDLDSKPKKGIIFEICSEDGFHIRCESIEEAWRSLTDKVQEARSNARLKELSFEGVNGLRMLGIVHEAVVFLLEQLYGSRHCHNYRFRFHKPDEPDEPPINPHGSARAEINHRRCVFDIFSFLASKHRQPPEYRPHEDDGDEGQLKTARRISMELPLAVRFKQLKVTSKESVGVYRSPIHGRGLFCKKTIEAGEMVIEYSGNVIRSVLTDKREKYYDGKGIGCYMFRIDDYEVVDATVHGNAARFINHSCEPNCYSRVITVDGKKHIVIFASRRIYRGEELTYDYKFPIEDASSKLPCNCNSKKCRKFLN

SEQ ID NO: 23734 - protein, 141 aa, Eimeria acervulina
MADDSTRQSASEAFEKSKEASSKAAGDMREKAADLSAAAKEKGCAAAEATREKAREAKERSSEACSSAADSAHGKGQEASEQGQSMYETISEKAHSMKDSVADAVSNTMTAAKDKAVSAKDTVSEGVTKLRSDAADLISPK

SEQ ID NO: 23735 - protein, 249 aa, Coffea arabica
PMVFNVVILSPHGYFAQENVLGYPDTGGQVVYILDQVPALEREMLKRIKEQGLDVKPRILIITRLLPDAPGTTCGQRLEKVYGSEYSHILRVPFRTEKGVVRKWISRFEVWPYMETFTEDVAKEVTAELQAKPDLVIGNYSEGNLVASLLAHKLGVTQCTIAHALEKTKYPDSDIYLSKFDEKYHFSCQFTADLIAMNHTDFIITSTFQEIAGSKDTVGQYESHMAFTMPGLYRVVHGIDVFDPKFNIV

SEQ ID NO: 23736 - protein, 323 aa, Yarrowia lipolytica
GLARKTTRTISCCSEIPSDLSMPQTLTRESMQPSRTQSSSQVERGSSLRKSTASIPATLETLSQQEEAASAAASATASLVDPPHSATPSEDDMSDEQIIAMQSEAPKNWIKGTLIGQGSFGCVHLGMNSLTGELMAVKQVSLGDFSKTSHKQAMVDALQREMNLLRDFQHDNIVQYLGSSSDEEYLNIFLEYVPGGSVSSMLTKYGQFEEPLVKHFVRQILKGLDYLHSRNIIHRDIKGANVLVDNKGNVKISDFGISKKIEASSSNRQSLQGSVYWMAPEVVKQTSYTLKADIWSLGCLIVEMLTGSHPFPQFSQMQAIFKI

SEQ ID NO: 23737 - protein, 518 aa, Caenorhabditis briggsae
MAGRKSSRTTGEPVKKAERKSAILSPHDELRERLLETSLDVKENIPERSSSTRNESVGSQRSDCSESRKRRSTEKGPVAKRPSTEKKGNGSRDDSFSSVFSEDRETESSVGSTSSRTRGQPLPAMPEEEESLDGSSDHNAESEESRETPQSDEHDGFEEDGDVEDDVSSDVNDEEDEYDEYEEDEETEDEFDLPLQNDDFAVTKRLMNDRHMIDAPSLLSYGKCEGIGSPTKVWSLMVKRDDIPRATRQLLRNHPDMTINMRRVLVDWMMECCDVEKLHRETFHLAVDYADRFLESTREEVISENFQLVGTAALFIAAKYEEIYPPKCADLAALTDGAFSCDDICRMESIVAKDLKWSFGPITSVQWLSTYLQLLGTGKKNNDHFEEGNMYIPELLRSEYLRMVRILDYLLSDIDSFNFSYRTIAAAVLFVNYDPRSAVEKATGFIYEQLRNVIDYVTPICRAYDRFTQEHVPKDIIPDYAPAEDAHNIQVHIKHYEVDPYVEKERERRHRRGPNRRL

SEQ ID NO: 23738 - protein, 1209 aa, Entamoeba histolytica
MDKIPHTFKDCTQPVENKKCVYCNKEIKKKQKAVYCTVCNIYLHEKKCIDKFRKEPTSCKRPIKVEVEMPPEEVVQQKFAIVAKEMKIDNPELITIPNQWKLVQEYEKKQKKDIRIQLNAQKTGNWRNAITDPKYLADLLKTRDDMDLLNEMVVVFRSSSVSFIKRFVSVGGLANLMAIYKKKIEAENSNTAIDEERKCCEVLRYVFAEEDATVALIRDSGGVELLLKRKNSKRITPDNQLDIFLEITLTSSMVEHPSQEGLYLGGDVCVMNAFSNLVSEGVDMKKFLSFFSLFSKSKSEKFKHASLVLINNLIDQPELEHRMDVRNSFIEIGLVNELENMKNTEWMKIDKIKDSINDFFDSWEEDKKEVESRFDDLKQVVDFESTKSLNNYVTEQMDKFECNDIFTNVHKEILFFAKLKDDNLLLIKKIVILTGIIRQISLQVTKNNNEKSNKKKIESGDNEEERIKIDEVFDRMKLDWEKVTVDQSILEDLNKKKQDLKNSKEQLQITLEKIKTIEKEVSSIDQENSEVNKELNDKKEKIQQIDTESKKINDEIEEVKKKIEQTKKELASKPKGVSVSGTSSLAPPPPPPGASSIPPPPPPPGASSVPPPPPPPGMPGMPGMPGMPPPPPPPGMPGMPPPPPPPGMPGMPPPPPGMPGMPPPPPGMPGMPPPPPGMPGMPPPPPGMPGMPPPPPGMPGMPGMPGMPPPPPGMPGMPPPPPGMPGMPPPPPGGFGFRPAAPVINGLVDTLPKPKSKLKNFMWQKMNDKNLSGTLFTKLDTLDKTKQKLDLSLIEAAFKVPEKLTSSRWQPQKKLKNKDLICILDAKNNQTFYNFALKGLRIKHQKRFVQPLIVLGQTVFGGTSTIKTMFKSSLKMLKEEIGQLKNHIKEKGTDNFRKCRDVCHALNGVSNITLKLNSFQSKMELPVKLEEVGPNIKHVIKASNQLLDSNKFIHLMEVILLMGNFLNSGTAKGNVAGFKFETLNKTLDTKTGDNKRTLLHSIQEYAAEKLKEEVDGWQNEVTEIPLAAKVPGAQFESDIKSLEKMYNDIQTAVGKIPEDGSKFHPIMKKFLEETRGKLDAVAKDFAEMNEIYKKAIQYMALDIAKPPPPEEFFTTLSTFISNWNRVTEENKKLQAQREKEAKKAEAAAAKKAGKKKTSLAPIPGEEGNMVKGRRQNPLAMEAAANVGGLKKTGFTFKKKTTKVLKTMDI

SEQ ID NO: 23739 - protein, 171 aa, Pringlea antiscorbutica
KLWPNAKYVSSIMTGSMLPYLKKLRHYAGGLPLVSADYGSTESWIGVNVDPHFPPEDVSFAVIPTFSYFEFIPLYRQQNQQDICSDGDFVEEKPVPLSQVKLGQEYELVLTTFTGLYRYRLGDVVEVTGFHKGTPKLSFIYRRKLILTINIDKNTEKDLQRVVDKASQLLS

SEQ ID NO: 23740 - protein, 1019 aa, Viscum album subsp. album
  unsure (1)..(1019): unsure at all Xaa locations
MAGNDWVNCYLEAILDADPGIGDAKSSLLLRERGHFSPTRYFVEEVITGFDETDLHRSWVRAAATRSPQERNTRLENMCWRIWNLARTKKQLEGDAARRKAKHHLDRERGRXEAAADMSDLSEGEKGDFTGDLSAHSDRRFPRISSVDVMENWINQHKEKKLYIVLISLHGLIRGENMELGRDSDTGGQVKYVVELARALGTMPGIYRVDLLTRQVSAPDIHWSYGEPTEMLNHGNPENLIEERGESSGAYIVRIPFGPKNKYIAKELLWPHIPEFVDGAIGHMVQMSKVLGDQIGGGESVWPVTIHGHYADAGDAAALLSGALNVPMLFTGHSLGRDKLEQLLKQVRVSLEEVNATYKIMRRIEAEELSLDVSEVVITSTQQEIDQQWRLYDGFDPILERKLRARIKRNVNCHGRFMPRMAVIPPGMEFHHIIPHDSDVDSEAEGNEDNAGSPDPPIFSEIMRFFSNPRKPMILALARPDPKKNMMTLVKAFGECRHLRELSNLTLVMGNRDDIDEMSTTNSSVLLSILKMVDKYDLYGQVAYPKHHKQSDVPDIYRLAAKTKGVFINPAFIEPFGLTLIEAAAYGLPIVATKNGGPVDIHRVLDNGLLVDPHDHQSIANALLKLVADKQLWLRCRQNGLKNIHLFSWREHCKTYLTRIASCKPRHPQWQRPDDLDSVSPGDSLRDIHDLSLNLKLSLDGENGVNDSFDNAIENAVACPNYVLEKAEHNISTGKVLTLRRRKHVFVCAFDCDGSTDFLENIKFVMEASGSSGSIGFVLSTSMAVSEVHSVLVSGGLSHLEFDAFICNSGGEVYYPSLSTDGLPYVSDLDYHSHIKYRWGGEDLRRTLVRWVGSMNDKMGEVVSEDEEGSTSHCHAFNVRNPDLVGPVRELRKSMRIQALRCHVVYCQNGYKMNVIPVLASRSQALRYLSIRWGMDLSNAVVFTGEYGDTDYEGLVGGVHRTVILKGVGGAAQKLHSDRSYPLSDVIPFESPNIVWTKGCRCSGDIRESLEQIGVVEGI

SEQ ID NO: 23741 - protein, 633 aa, Homo sapiens [sequence omitted]

SEQ ID NO: 23742 - protein, 576 aa, Mus musculus
MEGERAPLLGSRRPAVSAASAVFAGRRAACGAVLLAELLERAAFYGVTANLVLFLNGAPFDWEGAQASQALLLFMGLTYLGSPFGGWLADARLGRARAILLSLALYLLGLLAFPLLAAPRSRSFLCGDPRPELVRNCSAPFPNGSASCPENAARRCAPATFAGLVLVGLGVATVKANITPFGADQVKDRGPEATRRFFNWFYWSINLGANPVIRRYCYYSAECELFHRLPDSHQSLCGHCFPGSSSVARVSSSPSFLTEVPSLDMFRILTYSCCSQRGGQRRSGEGLGVFQQSSKHSLFDSCKMSRGGPFTEDKVEDVKALVKIVPVFLALIPYWTVYFQMQTTYALQNLHLKIPEISSITTTHHTLPAAWLTMFDAVLILLLIPLKDKLVDPVLRRHGLLPSSLKRIAVGMFFVMCSAFAAGILESKKLDLVKEKTINQTIGGVVFHAADLPIWWQILQYVLIGISEIFASIARQEFAYSAAPKSMQSAIMGLFFFFSCIGSFVGSGLLALVSLKAIGWMSSHTDFGNINSCHLHYYFFLLAAIQGATLLLFLIVSVKYDRQRARTDGGPASTRT

SEQ ID NO: 23743 - protein, 425 aa, Oryza sativa (japonica cultivar-group)
MEAPRLRLPFLLLVALVVSPPAVAAAASRMRIEPLPTAALRRLYDTSNYGKLQLNNGLALTPQMGWNSWNFFACNINETVIRDTADALVSTGLADLGYNYVNIDDCWSNVKRGKKDQLLPDPKTFPSGIKDLADYVHGKGLKLGIYSDAGIFTCQVRPGSLHHEKDDAAIFASWGVDYLKYDNCYNLGIKPKDRYPPMRDALNSTGRQIFYSLCEWGQDDPALWAGKVGNSWRTTDDIQDTWKSMTDIADKNNKWASYAGPGGWNDPDMLEVGNGGMTFAEYRAHFSIWALMKAPLLIGCDVRNMTKETMEILSNKEVIQVNQDPLGVQGRRILGQGKNGCQEVWAGPLSGNRLAVVLWNRCEESANIIVKLPSVGLDGSSPYSVRDLWKHETLSENVVGTFGAQVDVHDCKMYIFTPAVTVASS

SEQ ID NO: 23744 - protein, 268 aa, Oryza sativa (japonica cultivar-group)
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICSYPPVMMGERNDAAAAAAVAAQGQVQLRIGGLPPWMLSHLNA

SEQ ID NO: 23745 - protein, 109 aa, Oryza sativa (japonica cultivar-group)
MASKLQAFWNHPAGPKTIHFWAPTFKWGISIANVADFAKPPEKISYPQQVAVACTGVIWSRYSMVITPKNWNLFSVNVAMAGTGLYQLSRKIRKDYFSDEKDAAASLEG

SEQ ID NO: 23746 - protein, 484 aa, Oryza sativa (japonica cultivar-group)
MTTQACKKRRAVYISSESEDSGTDSEVEGSKLSKKDGVTSVYTCGHQPTSKNKVDPMNTSKSRQCGSILKKLMDHKSGWIFNTPVDPVVYGIPDYFDVIRNPMDLGTVKRKLTSKQYSNPYEFAADVRLTFSNAMKYNPPGNDVHGIADQLNKIFDSEWKLLERKWKDRNLVQEQPSLKVLKAQPAVTPKPVLPKGVTAGTNSAVSKTLATALSSKVKIKFSVRGSELTSSKDTPLQAVGRRDGTINQSLPCTKDNAKTPRIQSSEDRSESTGNELRPCDDASTSPLASSRQEEEYLPEEPLSPSKALRAAMLKSRFAGTIVKAQQKALLDHGKKIDPAKLQLEKERLEKRQQEEKARIEAQVKAAEAAAQLKLDEEMRMKREQERRAARLALHMMKKTVDIDNSDFLKDLENLSKKWELNPPGKLIVDFVDGIDLPPGLGSPLERLGLFMKKDLEEEVEHEMEDSVSPSTEIDVEEGEISFCQ

SEQ ID NO: 23747 - protein, 269 aa, Oryza sativa (japonica cultivar-group)
MSCHGGGGGGGEGALSRQGSVYSLTLNEVESHLGEPLRSMNLDDLLRTVLPAAAAAAETAGRKTVDEVWRDIQGASTGRHHATPMGEMTLEDFLSRAGVAVDGAASAAGAHWLRGHYPPPPPPTTTTLQYVGGSGAVVDGVYNRVDGHGVAGFLSQVGVAGRKRGGGVDGVVEKTVERRQKRMIKNRESAARSRARKQAYTNELENKISRLEEENQRLREHKAVADFSTFPSCVDFLKAFLTQKLEPVMQIVPQPEPKQQLRRTTSASF

SEQ ID NO: 23748 - protein, 605 aa, Oryza sativa (japonica cultivar-group)
MAVMTDVSTTGTALRTPAAGAVKEGDVEKLRFIDEMTTNVDAVQERVLGEILGRNAGTEYLTKCGLDGATDRAAFRAKVPVVSYDDLQPYIQRIANGDRSPILSTHPVSEFLTSSGTSAGERKLMPTIMDELDRRQLLYSLLMPVMNLYVPGLDKGKGLYFLFVKSETKTPGGLTARPVLTSYYKSDHFKNRPYDPYHNYTSPTAAILCADAFQSMYAQMVCGLCQRNDVLRLGAVFASGLLRAIRFLQLNWEQLADDIESGELTPRVTDPSVREAVAAILLPDPELAKLIRAECSKGDWAGIITRVWPNTKYLDVIVTGAMAQYIPTLEFYSGGLPMACTMYASSECYFGLNLRPMCDPSEVSYTIMPNMGYFEFLPVDETGAASGDATQLVDLARVEVGREYELVITTYAGLNRYRVGDVLRVTGFHNAAPQFRFVRRKNVLLSIESDKTDEAELQRAVERASALLRPHGASVVEYTSQACTKRIPGHYVIYWELLTKGAGATVVDADTLGRCCLEMEEALNTVYRQSRVADGSIGPLEIRVVRPGTFEELMDYAISRGASINQYKVPRCVTFPPIVELLDSRVVSSHFSPALPHWTPARRSE

SEQ ID NO: 23749 - protein, 545 aa, Oryza sativa (japonica cultivar-group)
MAPPPAAAAALAACILAVAATLAGADDPYRFFTWNVTYGSINPLGSTPQQGILINGQFPGPRIDCVTNDNIIVNVFNNLDEPFLLTWNGIKQRKNSWQDGVLGTNCPIPPGANYTYKFQAKDQIGTFVYFPSVAMHRAAGGFGALNVYQRPAIPVPYPPPAGDFTLLVGDWYKAGHKQLRQALDAGGGGALPPPDALLINGMPSAAAFVGDQGRTYLFRVSNVGVKTSVNVRIQGHSLRLVEVEGTHPVQNVYDSLDVHVGQSVAFLVTLDKAAQDYAVVASARFSPGASPLMATGTLHYSSAVSRAPGPLPAPPPEQAEWSMNQARSFRWNLTASAARPNPQGSFHYGTIATSRTLVLANSAPVLAGQRRYAVNGVSFVVPDTPLKLVDNYNIANVIGWDSVPARPDGAAPRSGTPVVRLNLHEFIEVVFQNTENELQSWHLDGYDFWVVGYGNGQWTENQRTTYNLVDAQARHTVQVYPNGWSAILVSLDNQGMWNLRSANWDRQYLGQQLYMRVWTPQQSFSNEYSIPTNAILCGRAAGLGH

SEQ ID NO: 23750 - protein, 249 aa, Oryza sativa (japonica cultivar-group)
MDYSAMPSPSPSSSAAAAAAAASGCCLDRLWRACGGCGAAAASAAGWTVCALLTCVFAVVGSLVGVFIGAFMGMSTESGMLRGAGVGVVSGAVFSIEAVESCIEIWRSSESGKYSIIFVLDIISSLFSGRIVWEKVSPALQRAVQSQMSLLSTPFIDNNDLFETGNTGGMSRDLINRIPKTTFSAATNPDQETDNCCAVCLQDFGASQFVRVLPHCQHTFHARCIDNWLFRHASCPLCRAGVHIDHIHM

SEQ ID NO: 23751 - protein, 178 aa, Oryza sativa (japonica cultivar-group)
MGMSTESGMLRGAGVGVVSGAVFSIEAVESCIEIWRSSESGKYSIIFVLDIISSLFSGRIVWEKVSPALQRAVQSQMSLLSTPFIDNNDLFETGNTGGMSRDLINRIPKTTFSAATNPDQETDNCCAVCLQDFGASQFVRVLPHCQHTFHARCIDNWLFRHASCPLCRAGVHIDHIHM

SEQ ID NO: 23752 - protein, 310 aa, Oryza sativa (japonica cultivar-group)
MAFLVERCGEMVVSMEMGPHGGGGAAAGKPVPAPFLTKTYQLVDDPCTDHIVSWGEDDTTFVVWRPPEFARDLLPNYFKHNNFSSFVRQLNTYGFRKIVADRWEFANEFFRKGAKHLLAEIHRRKSSQPPPPPMPHQPYHHHHHLNPFSLPPPPPAYHHHHLIQEEPATTAHCTVAGDGGEGGDFLAALSEDNRQLRRRNSLLLSELAHMKKLYNDIIYFLQNHVAPVTTTTTTPSSTAMAAAQHHLPAAASCRLMELDSPDHSPPPPPPKTPATDGGDTVKLFGVSLHGRKKRAHRDDDDGVHDQGSEV

SEQ ID NO: 23753 - protein, 202 aa, Oryza sativa (japonica cultivar-group)
MEEAEARPAPPDPNDARQRFLLELEFIQCLANPTYIHYLAQNRYFEDEAFIGYLKYLKYWQRPEYIKYIMYPHCLFFLELLQNANFRNAMAHPASKEVAHRQQYFFWKNYRNNRLKHILPRPPPEPTPTPAPAPAAVPPSASVPSTVVPPVAAPPSALLPMSAAGASAMSPMQFAGTPGTNIPKNDMRNVMGGQGGRKRKIG

SEQ ID NO: 23754 - protein, 373 aa, Oryza sativa (japonica cultivar-group)
MEAEKKPPAVSDVGAWAMNVVSSVGIIMANKQLMSSSGYAFSFGTLRAFARSSSSPFPSPQIWIRRFGFVPATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAVSLIILGPFADYYLNGRWLLNYNFSTGATFFILLSCSLAVFCNMSQYLCIGRFSATSFQVLGHMKTVCVLILGWILFDSALTVKNILGMLLAVMGMVVYSWAVETEKKASAPIPRNKSDMLDDSEDVPLKARVSGLPSSDLEEGEMKS

SEQ ID NO: 23755 - protein, 528 aa, Oryza sativa (japonica cultivar-group)
MASPDLFPNVSFSHVSVPAAAGASTEVTGGATAVFGGDASTGAPRLSLVWSGETQAKHTLEIDLSDAQIFKLGPTEWLCVSGESEAKDGVEEKSYSRAIKVVLRTEAESKAFYLAFQQWKHRVISGKAGEPLENGLIIGSKSKFDTKIEASSAKMYFHYYGQLLHQQNMLQDFVRTGTYYAAVMENRSDFEGRVVVDVGAGSGILSLFAAQAGARHVYAVEASEMAEHAQRLISGNPSLGQRITVIKGKVEEVELPEKADILISEPMGTLLVNERMLESYVIARDRFLVPGGKMFPTTGRIHMAPFSDEYLYVEMANKALFWQQHNFFGVDLTPLHGSAFQGYFSQPVVDAFDPRLLVSPPTFHTLDFTTMKEEELYEIDIPLNFVASVGTRVHGLACWFDVLFNGSTVQRWLTTAPGSPTTHWYQLRCILSQPLYVMAGQEITGRLHLVAHSAQSYTIYLTMSAKMWGEGAEQGGILQTSTAKLELKEPYYRLSQPQPYVMQQDQQQQQLPSLQPQSPLWDYHYGQD

SEQ ID NO: 23756 - protein, 321 aa, Oryza sativa (japonica cultivar-group)
MKFAKKYEKYMKGMDEELPGVGLKRLKKLLKKCRSDLQSHENDGSSAGRCPGHCSVCDGSFFPSLLNEMSAVIGCFNEKAKKLLELHLASGFKKYTMWFTSKGHKSHGALIQQGKDLVTYAIINAVAMRKILKKYDKIHYSKQGQEFKAQAQSLHIEILQSPWLCELMAFYMNLRRSKKNNGAMELFGDCSLVFDDDKPTISCNLFDSMRVDISLTCSICLDTVFDPVALSCGHIYCYLCSCSAASVTIVDGLKSAERKSKCPLCRQAGVFPNAVHLDELNMLLSYSCPEYWEKRIQMERVERVRLAKEHWESQCRAFLGM

SEQ ID NO: 23757 - protein, 230 aa, Oryza sativa (japonica cultivar-group)
MAARRPGSPAPRWAPWPLLAAAAVLLLLSAAPRTARALRFDLESGHTKCISDEIKVNSMVVGKYHVVGPDPNFPDNPLPDSHRISLRVTSPYGNSVHYAENVPSGNFAFTATEAGDYLACFWAPDHKPPVSIGFEFDWRSGVAAKDWSNVAKKGQVDVMEMELKKLEETIKSIHEEMFYLREREEEMQNLNKQTNSRMAWLGFLSLGICLSVAGLQLWHLKTFFERKKLL

SEQ ID NO: 23758 - protein, 334 aa, Pseudomonas chlororaphis
MALSKEVPEFDIDDEVLLMETDIATDSMSNEGSAVPSVRAKSKHSASLKQHKYIDYTRALDATQLYLNEIGFSPLLSPEEEVHFARLSQSGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIANLLEKPVGEVKRMLGLNERVSSVDVSLGPDSDKTLLDTLTDDRPTDPCELLQDDDLSQSIDQWLSELTDKQREVVVRRFGLRGHESSTLEDVGLEIGLTRERVRQIQVEGLKRLREILEKNGLSSESLFQ

SEQ ID NO: 23759 - protein, 172 aa, Oreochromis mossambicus
CQRTLREIKILLRFKHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYFDQ

SEQ ID NO: 23760 - protein, 350 aa, Homo sapiens [sequence omitted]

SEQ ID NO: 23761 - protein, 398 aa, Homo sapiens [sequence omitted]

SEQ ID NO: 23762 - protein, 674 aa, Homo sapiens [sequence omitted]

SEQ ID NO: 23763 - protein, 736 aa, Homo sapiens [sequence omitted]

SEQ ID NO: 23764 - protein, 374 aa, Equus caballus
STAGKVIKCKAAVLWEEKKPFSIEEVEVAPPKAHEVRIKMVATGICRSDDHVVSGTLVTPLPVIAGHEAAGIVESIGEGVTTVRPGDKVIPLWTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGAGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 23765 - protein, 507 aa, Proteus mirabilis
NSRYQNEDVAICVLVDISARVKMERSLQNMATAAEQANQAKSMFLATVSHELRTPLYGIIGNLELLQSLTQNEETARLLKTMDNSSSLLLKIISDILDFSKIESKQLKIDVKPFNCRQVVSFVISNYLPLIAKKDLAIYCFIEPDVPKIVNNDPVRVQQVISNLLNNSIKFTTTGCITLHLYRDEYYLYFDIHDTGRGINEKMLHQLFEPFFQVSQNTESASEGTGLGLAICEKLINLMDGDISVVSQENVGSRFTVRIPLYGALNSSDGQTKYNLYKESTIRCFISIKNLYLESFVERYLSYVGLHCQLFTEVTQVSENDFIITDHDECLDNSCQFIRIYEHYFEPAKKISENNWLCSTYKLNELIKIILQLPQTKLESDDSENNALMTDHDLQLLTVLIVDDHPINRLLLTDQLKKIGFNTATAEDGCDALAFMQENHVDIILTDVNMPNMNGYQLATTVRELSSTIPIIGVTANAIAEEKQRCIDAGMNDCVSKPVSLTVLKDV

SEQ ID NO: 23766 - protein, 252 aa, Prochlorococcus marinus subsp. marinus str. CCMP1375
MSIFVGNLPFRAEQEDVIQLFAPYGEVANCSLPLERDTGRKRGFAFIEMADEAAEAAAIEALQGAELMGRPLRINKAEPRGGGGGGRGGGYGGGGRGGYGGGGGYGGGGGYGGGGYGGGGGQGGYGGGGQGGYGGGGQGGYGGGGQGGYGGGGQGGYGGGGQGGYGGGGQGGYGGGGQGGYGGGGQGGYGGGGQGGYGGGQDTEQRASGAQGWEDRSYGSSDSSERDDTRSKRRRGASSEADQDADYGGAEG

SEQ ID NO: 23767 - protein, 432 aa, Prochlorococcus marinus subsp. marinus str. CCMP1375
MIDSLDLVIDSIFAREVLDSRGNPTVEAEVLLEGGAKGRAIVPSGASTGAYEAHELRDGGTRYMGKGVLRVVEHIEDRIAPSLCGLSASDQVNVDQIMRELDGTENKENLGANAILAVSIATARSAANAFGMPLYRYLGNPMSSLLPVPLMNVINGGAHAANNLDFQEFMLVPHGAESFREALRMGAEVFHTLKKLLSDKGLSTAVGDEGGFAPDLENNNAAGDLLVQAIEKAGFRPGEEISLALDVASTEFFKNGLYHFGEGKFSSEKMVEELKKLVNLYPIISIEDGLSEDDWSGWELLTKELGNKVQLVGDDLFVTNTKRLRQGIDRSIANSILIKVNQIGTLTETLEAIDLSHRMGYTSIISHRSGETEDTTIADLAVATRAGQIKTGSLSRSERVAKYNQLLRIEDQLGAQAVYAGSVGLGPRGLSK

SEQ ID NO: 23768 - protein, 428 aa, Prochlorococcus marinus subsp. marinus str. CCMP1375
MKTKVNNNLNGKKILVITTGSIAAVKIPLLVSNLIKTGAEVRCVVSPSASKLVSPLSLSTLSRNACYQDEDQWNRREPRPLHISLSEWADLIAVAPLSASSLSRWVHGLSEGLAASILLASEKPVIAAAAMNTAMWNNSSIKNNWETLKNFPNVIPLTPAEGLLACDRIGDGRMADPLLIQLAIESAIIQFRANSALHKDWSNLKLLVTAGPTIEDIDRARYLTNRSTGKMGVLIGQAARFRGATVDLIHGPIQVEAALLEGLQTFAVRNSNEMYSILEDLQSSADAIAMTAAIADLKPLVNTKNIKLSKEELFKSMKDRFEIVPDLLSKLIANRKNNQVFLGFTALTGNDEKIKELAMLKKKQKKCDLLMANPIDRSNQGFESDSNGGWLLGPEEAINEIKIGSKLSVAHQLLDELKSVLINKLKNK

SEQ ID NO: 23769 - protein, 496 aa, Prochlorococcus marinus subsp. marinus str. CCMP1375
MDNSKKTPEIERYSGQFDQTDWSSAYCNVEKECTNIKLKLISGQVPPRLKGSFYRNGPGKLERNGQWVHHPFDGDGMITLMRFNNGEVTFSNRFVKTQAWEEEEKADKFLYRGVFGTKKTGLAISNFGDVRLKNIANTHVVKLGNKLLALWEAAGPHALDPETLETHGLSSLNGALSPKEAFSAHPRFDPGHHKDPRMVTFGVSTGPKSTIRLMEFATKGSNAGNLISDRKDSFNGFAFLHDFAITPNWAIFLQNAMDFNPLPFIIGQKGAAQCLSSKSDGKGKFWLIPRHSGSFSNQPAKIIDAPDGFVFHHLNAWEENQSVIIESIFYKDFPTIGPNEDFRNIDFNQLPAGILKRCRINLLTNETEQETLSTQCCEFAMVNPYFQGLSAKYCWMATAAKNIGNGPLQAIKKLNLINKGSCEWSSSPRGFVSEPLMVPEDSTGNEDDGWILVMTWNGKFQTNELVILNANNLSHQATLEVPIKIPYGLHGSWSDS

SEQ ID NO: 23770 - protein, 250 aa, Prochlorococcus marinus subsp. marinus str. CCMP1375
MTSSSLLIGQTAIVTGASRGIGKAIALNLAQAGAEVVVNYANSATKAEEVVSLIKSTGGKAYALQANVADESSVNELVDTVLEKSDHIDILINNAGITKDGLLMRMKTEDWQSVLNLNLTGVFLCTKAVSRSMLKQRKGRIINITSVVGLMGNAGQANYASAKAGVIGFTKSAAKEFASRGITVNAVAPGFIETDMTKELDAEPILSAIPLGHFGSTEHVAGTVRFLAADPASSYITGQVLQVDGGMVMS

SEQ ID NO: 23771 - protein, 438 aa, Prochlorococcus marinus subsp. marinus str. CCMP1375
MTSATSSKSVTKQKSNVTKSKKTKSLLKEGSQKNQHSKNLSEKKSTSKKKAVTSITKKNNPTEPILSDENLEIAADQLLNATEMKNEESASLDIQNNDSLIGDLTDAEAREKALASIKLGPKGVYTEDSIRVYLQEIGRIRLLRPDEEIELARKIADLLHLEELAIQFESEHGNYPTKKEWAALVNMPMARFRRRLMLARRAKEKMVQSNLRLVVSIAKKYMNRGLSFQDLIQEGSLGLIRAAEKFDHEKGYKFSTYATWWIRQAITRAIADQSRTIRLPVHLYETISRIKKTTKVLSQEFGRKPSEEEIAESMEMTIEKLRFIAKSAQLPISLETPIGKEEDSRLGDFIESDSENPELDVAKTLLREDLEGVLATLSPRERDVLRLRYGLDDGRMKTLEEIGQIFDVTRERIRQIEAKALRKLRHPNRNGVLKEYIK

SEQ ID NO: 23772 - protein, 333 aa, Prochlorococcus marinus subsp. marinus str. CCMP1375
MNPEKLDVVAIGNAIVDVLINTEESFLREHSLAKGNMTLITQEKAEELYSKSDPSLETSGGSAANTIAGLSELGSNAEFIGRVKKDALGNTFKDDICSTGAVFNTPPIKYGPSTARCFIYVTPDAERTMCTYLGASVLLETKDIDFSILGETKILYLEGYLWDLEKAKSALKASAEECKKLGGKIALSLSDSFCIERHRESFQELLEKNIDILFANENEIISLYNSSSLDDAIENIKPKCEIAVITIGGKGSIIISGDEKYLIKPYNFGKVIDTTGAGDLYASGFLHGYVNGLDLQTCGNIGSTCAGYIVSQLGSRSKVSLKDIVIERLGLPA

SEQ ID NO: 23773 - protein, 334 aa, Prochlorococcus marinus subsp. marinus str. CCMP1375
MDRTLIQEILEVVEQAAIASAELTGLGQKDEADAAAVEAMRKRMGSIQMQGRIVIGEGERDEAPMLYIGEEVGSGSGPGVDFAVDPCEGTNLCANNQRGSMAVLAASDRGGLFNAPDFYMKKLAAPPAAKGKVDIRKSATENINILSSCLGMAVSELTIVVMDRARHKDLIAEIRSTGARVQPISDGDVQAAIACGFAGTGTHCLMGIGAAPEGVISAAAMRALGGHFQGQLVYDPAIAMTKEWADYTKEGNIARLNEMGITDGDKIYEADELASGENVVFAGSGITDGLLFNGVKFEKDCTRTSSLVISTLDSTARFTNTVHIKDGAKSISLS

SEQ ID NO: 23774 - protein, 445 aa, Prochlorococcus marinus subsp. marinus str. CCMP1375
MKDEVLAQLNDLKIGKDTSITSNSHNENSRKKESHAKAKEPSNQLKNGLLGWYAVCSKRELKEDTPYCLTMFNEPLVIYRDKESNLRCVKDLCPHRGASFIGGEVIDGELVCPYHGARFSSNGECTNLNRITCNHIVDDNYNNYASKIHLYQYICKEIGDYIYIYYTGNAKTSLKDFEVTDQLETRFVESYGFDISDYAYEEVIVDFKCDWARIVENHIDILHLFWVHGETIPDNDVNRKVITSFNQEITREKNQIESKYKYKDKGNKEFIRIKFLPPGRVVIYKGDPSDSRYIQILDHIPLSNNQARVIVRHYRKFMKNKFITELLLFKKLQHRVFYKVFAEDYMILRTQTYNNQMGFVEKDNIKLLGEDKMVQYYWDWFKSSNIKDNPWELFPTNTDTNTVHQDIAMLYPPANNTRVKENSRSLFINILIRILIPIGFLVVLI

SEQ ID NO: 23775 - protein, 643 aa, Prochlorococcus marinus subsp. marinus str. CCMP1375
MRLSDVSHPNQLHGLTTAQLEDVACQIRERHLQVVSTSGGHLGPGLGVVELTLALYQTLDLDHDKVVWDVGHQAYPHKLLTGRYGDFDSLRQQNGVAGYLKRSESSFDHFGAGHASTSISAALGMALARDRQGKDYKCVAVIGDGALTGGMALEAINHAGHLPSTPFLVVLNDNDMSISPPVGALSTHLNRMRHSAPIQFISDSVQEGVRNIPFIGKEIPQEIKSLTGSVKRLAVPKVGAVFEELGFTYMGPVDGHDIAQMTRTFQAAHRIGGPVLVHVATTKGKGYPYAEADQVGYHAQSAFDLTTGKSIPSKTPKPPSYSKVFGQTLVKICEQNSKVVGITAAMATGTGLDLLQKAIPDQYIDVGIAEQHAVTLAAGMACDGLRPVCAIYSTFLQRAFDQLIHDVGIQNLPVTFVMDRAGIVGADGPTHQGQYDISYLRSIPNFTVMAPKDEAELQRMLVTCLSHDGPTALRIPRGPGEGVTLMEEGWDPLKIGRGEILSEGSDLLIIAYGSMVAPAQKTALCLKESGISATVINARFLRPLDQGLIHPLARRIGKVVTMEEGTLLGGFGSAIVESFADQDIAVSTYRIGIPDKLVHHASPQQSKEELGLTPTAMADNIKKRFGWDNSDSLFVKNSNTSTI

SEQ ID NO: 23776 - protein, 1182 aa, Prochlorococcus marinus subsp. marinus str. CCMP1375
MIDFKSYINSSKSSVLVFDGAMGTSLQSLNLTADDFGGTLLEGCNENLVLTNPQAVRNVHRSYLEVGCDVIETNTFGATSIVLEEYNLQDKTYEINLEAARLAKGIVKEFSTDDKPRFVAGSVGPTTKLPTLGHISFDKLSSSYQEQIEALIDGEVDLILLETCQDVLQIKSALVGINNAFEIKDKYLPIMVSVTMETTGTMLLGTDISAVVNILAPFNIDILGLNCATGPHEMKRHIEYLSEYSPFLISCIPNAGLPENIGGKAHYRLTPIELKMQLSHFINDLGVKVIGGCCGTGPTHIEQLVKLSQEVIDTIEQKEFKKNTDYGVSSLYEMTSYNQDQSILIIGERLNASGSRKVRELLNENNWDGLIAVAKDQLKEQAHVLDVNVDYVGRDGVEDMSKVVSQLVTNINLPLMLDSTDYTKMESGLKNAGGKCILNSTNYEDGPERFYKVLDLCKKYGSAVVIGTIDENGMARTSDLKIKIAERSFNDATKYGIAEFDIFYDPLVLPISTGLEEDRNNASETIKAISILRKRFPHVHITLGISNVSFGLNPAARITLNSVFLEECIVAGLDSAIISPAKILPTQKIKPEHRKVCIDLIYDKRLYKDDICIYDPLTELTSLFSDVTSQSLKQRTDELKSLPLEERLKKHIIDGEKNDLREHLLVALDDYKALDIINNFLLDGMKVVGELFGSGKMQLPFVLQSAETMKYAVSVLEPYMETNESVQSKGKFIIATVKGDVHDIGKNLVDIILTNNGYDVINLGIKQDISEIINAQKKFQADCIAMSGLLVKSTAFMKDNLQELNNNLISIPVILGGAALTPKFVNQDCNNVYKGQVIYGKDAFTDLTFMDAYMKAKSNAKWDNYKGFLDHNPTGIQLFEKSNCSISEAAEKSSPTKTNSIKLSTSKSPVIKEEISISPPFIGSKIVHDDNINLDNLMFYLDKRALFAGQWQFKKTKDQTKESYQEFIDTEATSILNHWINRIKEDNLISPAFVYGYFPCGSNGNNLEIFDFDGKKRIGCFTFPRQKANNKYCISDFYNPLKENSPVDYIPMQAVTMGNVSSEFAQVLFAEDRYSDYLYFHGLTVQLAEALAEYSHANIRQECGFVINEPDNIRDILAQRYQGCRYSFGYPACPNVSDSKKQLDWLQASRIGISMDESDQLIPEQSTTAIISLHSQAKYFSA

SEQ ID NO: 23777 - protein, 164 aa, Prochlorococcus marinus subsp. marinus str. CCMP1375
MQFTKPVKLNDTQIHRWMMILRKRAKIVGKEGEVPITAIILNEKGHCIGHGRNTRNKRFDPMGHAELVALRQAAWLKGDWRFNECTLIVTLEPCQMCAGALIQARMGRVIFGAYDFKRGGLGGTLDLSTHKSAHHKMIVKGGVMKKEIKQEIEEWFSLRRLIKL

SEQ ID NO: 23778 - protein, 455 aa, Prochlorococcus marinus subsp. marinus str. CCMP1375
MAILRPFEKDQDKSSPNRNIAPITAALDSQERLSIGGCLLSSLAEKYGTPLYILDELTLRTSCREYKDALSKYYPGDSIPLYASKANSSLIISNIVASEGMGVDVVSEGELITALKGGVESSNIVFHGNNKSKSELIMAYKNDVIIVLDNQYDIDQLREIVPFGKRKAKLMLRFTPGIECHTHEYIKTGHIDSKFGFDPDELESIFLQFKDIEWGELIGLHAHIGSQIFEVQPHKDLADVMASALQTGRKLGHSLNALNLGGGLGIRYIASDDPPSISDWVEVIAAAVVKACRERSLDLPLLMCEPGRSIVGSAGLTLYKIGSRKEIPGIKTYLSVDGGMSDNPRPITYQSEYSACLVDKPLIRADEVVTIAGKHCESGDVLLKDFRLPRSNSGDVLGVFSTGAYNFSMSSNYNRIPKPAAIIVGNGESELIQKRELPEDLLRNDILPDRFIAKG

SEQ ID NO: 23779 - protein, 387 aa, Prochlorococcus marinus subsp. marinus str. CCMP1375
MNIQLGHSKFVRRAYGIDEIALVPGGKTVDPENTDTTLLIGGKSLEIPIIASAMDGVVDVNMAVALSKLGSLGVLNLEGVQTRYEKPNDVLKRISSVGKEEFVPLMQEIYKQPIKENLINQRIQEIKDQGGLAAVSGTPLAAIKFKDTITKAKPDLFFLQATVVSTEHIGGGKQEKLEISNLCQTLGIPVIVGNCVTYEVALNLMRAGVSGILVGIGPGAACTSRGVLGVGVPQATAISDCSAARDDYKKETGNHVPVIADGGIITGGDVCKCIACGADGVMIGSPIARASEAPGNGYHWGMATPSPVLPRGTRIKVGSTGNLMQILRGPAKTDDGTHNLLGALKTSMGTLGAQTIKEMQEVEIVIAPSLLSEGKVYQKAQQLGMGK

SEQ ID NO: 23780 - protein, 98 aa, Prochlorococcus marinus subsp. marinus str. CCMP1375
MTIFIGNLSFDAEQEDIIGVFTSYGEVKDCKIPLDRETGRKRGFAFVEMVNEADEQKAIDDLQDVEWMGRNIRVNKAEPRRDSRDGRRSDYGGGRNRR

SEQ ID NO: 23781 - protein, 412 aa, Prochlorococcus marinus subsp. marinus str. CCMP1375
MLGSTGSIGTQTLEIAKECPEQFKVVALTAGRNLDLLIKQIQEHQPEVVALARKDILPELQERLNSLTGKERPNALPHLVAGNDGLNIAASWHSADLVVTGIVGCAGLLPTLAAIKAGKDIALANKETLIAAGPVVIPELKRSGSRLLPADSEHSAIFQCLQGTPWPENARLSTGIPTPGLRNIQLTASGGAFRDWATEDLKHASIKDATSHPNWSMGKKITVDSATLMNKGLEVIEAHYLFGLDYDHIEIVIHPQSIIHSMIELNDSSVLAQMGWPDMKLPILYAMSWPNRINTSWRRLNLSEIGKLTFHEPDTSKYPCMELAYAAGKAAGTMPAVLNAANEEAVALFLEEKIHFLNIPKVIEAACENHKKDLKFDPQLQDVIEVDYWARREVRSQVQKDSNQITMATYKK

SEQ ID NO: 23782 - protein, 308 aa, Prochlorococcus marinus subsp. marinus str. CCMP1375
MRNSFATTLTEIARNDPKVILLAGDIGFRIFDKFIEEFPDRFINCGIAEQNMVSVAAGMASAGRRPIVYTIIPFLIMRSFEQIRVDIGINQQGVVLVGVGGGLAYDKLGSTHHAYEDIALMRTIPSMKIFTPIDPEDVSNCFIQSYNLAKSDIPSYIRLSKGGEPNITRIKEVSSNIKFLKSSNITSNLFITHGSISSLVVDALEDNKYSNVSVISISELSKDSLLKLTNLLIENLQLLKQVSIVEETFPTGGLHEALSSILMKENVPLGIKHICLDHRYIFDINNRVSLLSKYGIEKSIIQEIALKK

SEQ ID NO: 23783 - protein, 320 aa, Prochlorococcus marinus subsp. marinus str. CCMP1375
MFEKMNWLLMVLPFALWGSAMAAMAPLVQSSGPEFVAILRLFPSGIAILIAVIILKRPLNIARIDLGWFLVFTLIDGSLFQFFLTRGLVNSGAGLGSVFIDSQPLIVALLARTLFGDPINPIGWIGLVLGLGGIICIGTPPELLSHWFLMNKGVSESDVLANGQFWMLGAALAMALGTVLIRFTCKASDPVAVTGWHMVFGSIPLAVWHFFDKSWPLFPQWSAFDWGLMSYAAFLGSALAYGLFFWFASQTELTSFSTLAFLTPVFALITGGVWLGERLDWVQWIGVSFVLFSVFLVSQRARLWEPISDSRNNLFKGISG

SEQ ID NO: 23784 - protein, 313 aa, Prochlorococcus marinus subsp. marinus str. CCMP1375
MVSSAPKPAESQKRRSTDPISWYLATIGRVPLLTPAEEIELGNQVQVMMNLTEDGMVNEKTKKFTSHERRSIRIGRRAKERMMKANLRLVVSVAKKYQGKGLELLDLVQEGSLGLERAVEKFDPTRGYKFSTYAFWWIRQSMTRAIACQSRTIRLPVHLSERLATIRKVSLDLAHKLGAMPNRLEIAEEMDIEVEELDSILRQALTTSSLDAPVNGDDGRSFLGDLIADSSVEEPLDKVEQSIHQEQLGRWLTHLSEQEQHVLKLRFGLEGNDRHTLAEIGRLLEVSRERVRQVELKSLRKLRNLTRKLPSGI

SEQ ID NO: 23785 - protein, 690 aa, Prochlorococcus marinus subsp. marinus str. CCMP1375
MTTNNINQIEPTQEEERSDDKTSHPGLKPLINKWWDEFSLRAKLLAIATLIVSLLMSGITFFALSSIQRDAGMNDTRYARDLGLLLSGNVTELVAKGQERELFNVAEKFWRSSRNIRYIFFTDTEGIVQLGIPISATPSDSKSEFQLRKKLQLPQELKKRPQFPLVRQHLTPQGQVTDVFVALLFKGKYVGNLALGVTPNKSALASAALTREITIAVFISIWILVIIGAVFNAQTITKPIRELVSGVREIAKGNFKSRIILPMSGELGELLDGFNNMASQLEDYDAANIEELRAAQVKQQSLIATMADGAILLNEKGKIVLVNPTARRLFRWEGRNLESQDLLDELPELIANELHPNITSILNNLCESDELRCSTGEPARTLRIVLQSVRDSSGSTLKGVAITIQDLTREVELNAIQRRFISNVSHELRTPLFNIKSYVETLHDLDDKLDHKEKMEFLEVANSETDRLTRLVNDVLDLSKIETAGNVNFEAINLAPAIDQTVRTYRLNAEDKKVEISQEIEENMELILGNWDLLLQVLDNLIGNALKFSSAGGKIVLRAYTWPDTCITSSPKIDKKDAPSCEIIYPLPRLRIEIGDTGCGISEDSQLRIFERFYRVENDVHTEVGTGLGLSIVREIIEKLGSNIRMVSIPGIGTTFWFDLPLAINDADEILVESERMRLKWDRKLEEELT

SEQ ID NO: 23786 - protein, 112 aa, Prochlorococcus marinus subsp. marinus str. CCMP1375
MKKIEAIIRPFKLEDVKIALVNLGIVGMTVSEVRGFGRQKGQVERYRGSEFTVEFLQKLKIEVVVADESVDGVIKAIAEAAKTGEIGDGKIFVSSIETVLRIRTGESDDSAL

SEQ ID NO: 23787 - protein, 309 aa, Prochlorococcus marinus subsp. marinus str. CCMP1375
MIAFLLPIVSLLVLSLIFLWLFNDRKYKSSESVSSAYDSWTNDRLLEKLWGEHIHLGYYENSYKTKDFRQAKIDFVHKLAHWSGLSTLPKGSRIIDIGCGIGGSSRILAKDYGFDVVGITISSEQVKRANQLTPKELKCHFEIMNALNLKFEDGSFDGVWSVEAGPHILNKQLFADEMLRVLRPGGVLAVADWNRRDYAKKEIGFLNSLVLKQLLNQWSHPDFATIYGFRNNLSDSIYSAGRVETDDWTKYTIPSWNDSIIEGIRRPNVFFDLGLGSFFKAIREVPTIVLMRWAFHTGLMQFGVFRSRG

SEQ ID NO: 23788 - protein, 359 aa, Prochlorococcus marinus subsp. marinus str. CCMP1375
MLSEEELLKALSSIKDSGSNRSVVDLGWLDQLRINHPKAIVRLNLPSYAQSQRDRIAAEAKRIVESYREISELQIELSNANGQSEIGNAGHGQVSSLQKIPGVKNVIAVSSGKGGVGKSTVAVNLACGLSQKGYSVGLLDADIYGPNTPIMLGVSDKTPEVQGSGAEQKIIPIESFGISMVSMGLLIDDNQPVIWRGPMLNGIIRQFLYQASWGEKDFLVVDLPPGTGDAQLSLAQAVPMSGVLIVTTPQKVSLQDSRRGLAMFKQMNVPILGVIENMSSFIPPDQPEREYAIFGTGGGQVLSEENSVPLLAKLPLEMNTSNGNEEDKPIVFQYPDSKTAKAFERLALSVLEIIETNSN

SEQ ID NO: 23789 - protein, 476 aa, Prochlorococcus marinus subsp. marinus str. CCMP1375
MVTAAASTSQVVGDSDFVVADITLADFGRKELAIAEKEMPGLMSLRDKYGQEKPLQGARIAGSLHMTIQTGVLIETLVALGAQVRWASCNIFSTQDHAAAAIAKAGVPVFAKKGETLSEYWSFTHSILEWSGEQGPNMILDDGGDATGLVILGSKAEKDISVLDNPSNEEEIALYASIKSKLSTDKSFYSRIKKIILGVTEETTTGVARLYQMQKNGELPFPAINVNDSVTKSKFDNLYGCRESLVDGIKRATDVMVAGKVALVIGYGDVGKGSAQSLRGLGATVMIAEIDPICALQAAMEGYRVVRLDDVVEEIDIFVTATGNFQVICHDHLIRMKDEAIVSNIGHFDNEIDVASLKSYQWENIKPQVDHITLPSGNKIILLAEGRLVNLGCATGHPSFVMSNSFTNQVLAQIELFKKGDSYQNNVYVLPKHLDEMVARLHLDKIGANLTELSKEQADYINVPIEGPYKSEQYRY

SEQ ID NO: 23790 - protein, 328 aa, Prochlorococcus marinus subsp. marinus str. CCMP1375
MSSYNPLIVPAKKSATEIDLVRSYLRDIGRVPLLTNEQEITLGRQVQELISLEKLERELESTNGKKPSKEDLAIDAGISVRELSKRLKRGVRAKERMVSANLRLVVSVAKKYTKRNMELLDLIQEGTIGLVRGVEKFDPARGYKFSTYAYWWIRQGITRAIAEKSRIIRLPIHITELLNKLKKGQRELSQHLERTPTMQELSAYVEIPVEEVKDLMFRASQPVSLESKVGDGEDTSLLDLLAIDTDLPDQQIELDCMKGDLEVLLQKLPELQNRVLRMRFGINGEEPMTLTGIGRMLGISRDRVRNLLRDGLKGLRQYGHQVEAYVAC

SEQ ID NO: 23791 - protein, 248 aa, Prochlorococcus marinus subsp. marinus str. CCMP1375
MLKSFHSDLEIIRERDPAARGFIEILLCYPGFQALILHRISHKLWNIGLPLFPRVLSQITRSLTGIEIHPGAKIGKGVFIDHGMGVVIGETAEIGNRCLLYQGVTLGGTGKSHGKRHPTLSENVVVGAGAKVLGAIAVGANTRIGAGSVVVRDVEADSTVVGIPGRIIHQSGVRINPLAHSALPDAEATVIRNLMKRIDYLESQVQLLTNNLQTISKGNMPNKIISGEAQNLKDREIIEFLGDTLKED

SEQ ID NO: 23792 - protein, 464 aa, Prochlorococcus marinus subsp. marinus str. CCMP1375
MGLKLLHLHLHGLIRSHDLELGRDSDTGGQTLYVLELVKELAASLEVDQVDLVTRLIQDRRLASDYSRPRERIAPSANIIRIPFGPKRYLRKELLWPYLDQLVDQLIDQLKQAKTLPDWIHAHYADAGYVGALVSSRLGIPFVFTGHSLGREKKRRLLESGMDHLQIENTYSISRRIGAEELALANANLVVTSTFQEANEQYSRYKNFVSKQAKTIPPGVDLRRFNTISKPNEFEEVQDLFAPFLRKPNLPPLLAISRAVRRKNIPALIEAFGRSPLLRQKHNLVLILGTRTDMKLLDKQQKDVFQQIFELVDKYQLYGQVAYPKFHRRDQIAPIYRWASKLEGLFVNPALTEPFGLTLLEAAACGLPMAATDDGGPKDILSSCRNGLLFDATDLDVLQNTLELAGSNKKLWQQWSSRGIDGIKKYYSWNSHVSKYLSLMKNQFNLSSTQSLAQVIPLSGIRAS

SEQ ID NO: 23793 - protein, 415 aa, Mus musculus
MLQKTVLLLALVAQVLMLENGLLRTPPMGWLAWERFRCNIDCVEDPKNCISDGLFMEMADRLAQDGWRDLGYVYLNIDDCWIGGRDASGRLIPDPKRFPHGIAFLADYAHSLGLKLGIYEDMGKMTCMGYPGTTLDKVELDAETFAEWKVDMLKLDGCFSSSRERAEGYPKMAAALNATGRPIAFSCSWPAYEGGLPPKVNYTEVSRVCNLWRNYKDIQDSWKSVLSILDWFVRHQDVLQPVAGPGHWNDPDMLLIGNFGLSFDESRAQMALWTVLAAPLLMSTDLRTISPQNMDILQNPLMIKINQDPLGIQGRRILKSKSHIEVFKRYLSNQASALVFFSRRTDMPFRFHCSLLELNYPKGRVYEGQNVFTGDIFSGLQTEVNFTVIINPSGVVMWYLYPIKDLGISTMMSHW

SEQ ID NO: 23794 - protein, 417 aa, Orychophragmus violaceus
YHHSFTFFLLVIFVLFRHVISINTLSPNEALTISSNQTIASPNDVFELGFFKTTSSRDGTDRWYLGIWYKTTSKRTYLWIANRDNPLYNPNGTLKFSHANLVLLTYFDIPVWSTNLTTTFKSPVVAELLDNGNFVLKDSKTKDSNRFLWQSFDFPVDTLLPEMKIGRNLKTGNDRYLTSWKSPTDPSSGDHSFKLETKGLPEFYLWQEDFIKYRSGPWNGIQFNGIPAMQNWSHIINSLIENREEVVYTFQDLNQNIHSRFRISSGGSLQVITWTSTVPQRNMFWSLVEDECDIYNRCGPYAYCDMNTRPTCNCISGFLPKNATAWASGDMSYGCVRKTLLSCGKGDRFLKLRQMKLPETSGAIVDKRIGLKECEERCVRDCNCTGFANTDVWNGGSGCVIWTGEAGELIDMRNNVV

SEQ ID NO: 23795 - protein, 410 aa, Erysimum cheiri
YYHSFTFFFFFVVLVLFPHVFSINTLSSTETLTISSNQTIVSPGNVFELGFFKITGDRWYLGIWYKAISERTYVWVANRDSPLPSSSGTLKISYANLVLLDHSDTPVWSTNVTKPVKSPVVAELLDNGNFVLRDSESNDRNRFLWQSFDFPADTLLPEMKIGRNLKTGHESFLRSWRSPYDPSSGDFSFKLQIHGLPEFYLYEKDFILYRTGPWNGVGFSGIPTMQNWSYFHFVNNFIENREEVAYSFKVTNKTLPSRFTMSSEGSLQMLAMSTTSEWNLFGVLPIEECDLYQICGSYSYCDMKTSPVCNCIKGFYPKNVTAWALGETFDGCVRKSRLSCRGDGFLLMKRMKLPDTSTSIVDKRIGLNECKERCSKDCNCTGFANKDIRNGGSGCVIWTGELRDMRNYVT

SEQ ID NO: 23796 - protein, 263 aa, Danio rerio
PKPTVLDGAKVTYGGRFSDEKVEEVKSLVKILPVFLALIPYWTVYFQNTFRFPAAWLTMFDAVLILMLIPLKDKVVDPILKRKGLLPSSLKRIAVGMFFVMCSAVAAGILETKRLDIVRTRGPIPQSLGGVIYYAADLPIWWQVPQYVLIGVSEIFASIAGLEFAYSAAPRSMQSAIMGLFFFFSGIGSFVGSGLLAIVSLKAIGWMSSHQDFGNINECRLNYYFFLLAAIQGITLLIFLIVSVKYDKQKPKPASHRASMSNS

SEQ ID NO: 23797 - protein, 2362 aa, Danio rerio
ISSMLASLTLDLSQYALDIGKGISSQLKANNPELMEQAVAALQNLTQQCSDPSAVQDLTKHLFNILAGSEGKLTVVAQKMSVLSGIRSCSHHAVSGSSSQSLSSSVAVMFIPYLQQEVHEGTLVHAVSVLSQWTSRLTLDVPSELRDWFKKAFTLKTSTSAVRHAYLQAMIGAFKGDSLSQAVDFLPLLIQTVEKAAAQNTQHTLLSEAVAASVLLCRLSVLDSVSEAKLTSFWNLILDEKKPLFTTEKFLSQASEEALCTVLLLCERLFLDQPQRLNNSKSQMYHQATVMPLLSRLWPVRKRAQQTVKKLLSSLGGSSLAHGLLAELRVVINKHKILPADVLYTETGELTETGRSYVSPRVLQEALSVICSVAAQWNAPDETEKLALEILIVTHHPSIVAVRSELWSSLLSAMKLDAAQFIDKHLEVILPRLLEANTDNQAVQNAVGSLSLLSPNKLLPRVMDHVTQRLSNPALSLVTRQEYAIMQTPEGELYDKSIIMSAQQESTKKGNMKRENKAYSFKEQIIELELQEEIKKKKGIKEEIQLTSKQKEMMQIQLEKESTIRKRLQELDMELQCAVGLLEAALARRPPLIWMHLPALVQVLLPLLQSPLAASLIKRVFLQIGVTLMPKELHQLAVLVGHVTLRLLKPECDLDPAWAQEDLNTATQRTISLLHQRDGKTAFSFCFPLLQAVLSQSSGSSEESELMMTRALQVINTHAQLRAQDDTTDTFIDENGPELLPRVSMLQLLTKVIGTSTPRLQVLASSCLTALCGSAGGQEGCALAEQPEIDVLLEALLSSCFSVRDAALRLALPTDSTDVNGLKMLRRLWVAKFDVEEEARALAEKLWQALCLDLVPELCPLLIEDVIQHEEAVRSAGAEALSSAVSQYQEQSATVLSQLTQLYHQKLYRPPPVLDALGRVISEAPPDQWEARCGIALALNKLAEYLDESQVTPLFLFFVPDALNDRHPEVRRCMLDAALSALNTHGKDNVSSLLPVFEEFLKNAPQDASYDSVRQSVVILMGSLAKHLDKSDPKVKPIVAKLITALSTPSQQVQESVASCLPPLVPAIKEDAGGMVRKLLQLLLESDKYAERKGAAYGLAGLVKGLGILSLKQQEIMTTLTDAIQDKKNSRRREGALFAFEMLCNMLGKLFEPYVVHVLPHLLLCFGDGNQYVREAADDCAKAVMRNLSAHGVKLVLPSLLVALEEESWRTKAGSVELLGAMAYCAPKQLSSCLPNIVPKLTEVLTDSHVKVQKAGQQALRQIGSVIRNPEILAITPILLDALTDPSHRTQHCLQTLLDTKFVHFIDAPSLALIMPIVQRAFQDRSTDTRKMAAQIIGNMYSLTDQKDLSPYLPSVIPGLKASLLDPVPEVRTVSAKALGAMVKGMGESSFEDLLPWLMETLASEQSSVDRSGAAQGVEKLDKLMPDVVQTASKVDIASHVRDGYIMMFIYLPLTFGDKFTPYVGPIIPCILKALADENEYVRDTALRAGQRIISMYAETAIALLLPELEQGLFDDLWRIRFSSVQLLGDLLFHISGVTGKMTTETASEDDNFGTAQSNKAIISALGAERRNRVLSGLYMGRSDTQLVVRQASLHVWKIVVSNTPRTLREILPTLFTLLLGFLASTCPDKRTIAARTLGDLVRKLGEKILPEIIPILEDGLRSDKSDERQGVCIGLSEIMKSTSKDAVLVFSESLVPTVRKALCDPLEEVREAAAKTFEQLHTTIGHQALDDILPALLKQLEDEETSEFALDGLKQVMAVKSRSVLPYLVPKLTAPPVNTRVLAFLSAVAGDALTRHLGVILPALLSSLKDKLGTEESLQELSNCQTVILSVEDEVGQRIIIEDLLEATRGADAGLRQASITILNGYFSRTRLDYSAHTRTLLSGLMRLMNDPNTEVLSQSWDTINSITKKLDAGSQLSLIDDLHRDIRSAAAEVKGQHLPGFCLPKKGVTCILPVLREGVLTGSPEQKEEAARALGGVIKLTSAEALRPSVVNITGPLIRILGDRFAWNVKTALLETLTLLLAKVGIALKPFLPQLQTTFLKALQDSSRAVRLRAAEALGQLVSIHTKVDPLFTEQLAAIRNAEDSGVRETMLQALRFVIQGAGAKVDPAIRKNITTTLLSMLGHDEDATRMASAGCIGELCAFLSEEELKSVLQQHILADVSGVDWMVRHGRSLALSIAVKSASAQLCVDEYNSSVLEAVLSSATADRIPIACSGIRAMGFLMRHQLRTGGSESVSPRIITQFIKCLQNQSSDIRLVAERVLWWVWKEDETPILEPSLVKPLIKALLDNTKDKNTSVRAQSEHTLVSLLRLRRGEHNMQSISAILDSASNDLLSECYRRSLKKISSLPDSNEEIDDTILT

SEQ ID NO: 23798 - protein, 579 aa, Danio rerio
MKWNLVFLGLLLTFGQLSWGQKGMDIPEYDGKDRVHELNAKNYKSVMKKYDVMVVYYHEHVGSSKVAQKQFQIEELALELAAQVLADFDDEDIGIGLLDEKTDKAVAKKLGLDEADSIFIFIEDEVIEYDGELAADTLVEFIYDVIEDPVEIIGNVREMKGFNNIEEDIKLVGFFKSAKSDHYHEYEDAAEEFHPHIKFFATFNPKVALKLGLKLNEVDFYEPFMDKPVVIPGKPYSEKELVRFIEDNDRPTLRKMQPHNMYEIWEDALDGEHIIAFAEEGDPDGFEFLEIVKEVAEDNTENPDLSIIWIDPDDFPLLVHYWEKTFDIDLSSPQIGVVEVDDAESIWFDMDDDDMPTVDELEDWLEDVLENKIDPDEDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDDED

SEQ ID NO: 23799 - protein, 247 aa, Acinetobacter sp. NCIMB9871
MSNKFNNKVALITGAGSGIGKSTALLLAQQGVSVVVSDINLEAAQKVVDEIVALGGKAAANKANTAEPEDMKAAVEFAVSTFGALHLAFNNAGILGEVNSTEELSIEGWRRVIDVNLNAVFYSMHYEVPAILAAGGGAIVNTASIAGLIGIQNISGYVAAKHGVTGLTKAAALEYADKGIRINSVHPGYIKTPLIAEFEEAEMVKLHPIGRLGQPEEVAQVVAFLLSDDASFVTGSQYVVDGAYTSK

SEQ ID NO: 23800 - protein, 397 aa, Caenorhabditis elegans
MGMSATMGDSASIPGVFFADFGPAPPEITPEGYHEVELNKTKWVLPQWYNSLKPLGEGAYGVVCTAEYEPTGDRVAIKKFFRPFQSTIHAKRTYRELKLLRTLQHDNVLEMIDVFTPDPDASSLNNVYFVSVLMGSDLQNIMKIQRLTDEQIQLLIYQVLRGLKYIHSAGIIHRDLKPSNIAVNERCEVKILDFGLARAQDAEMTGYVATRWYRAPEIMLNWMHYTQTVDVWSVGCILAELVSGRPLFPGDDHIDQLTKIMSVVGTPKEEFWSKIQSEEARNYIKNRSPIIRQDFVTLFPMASPYALELLEMMLILDPDRRISVSSALRHDYLREYSVPNDEPVAMDTVTIDPAEERATTLSDWRELIWNEIRLFQNSARRLSFVSCTDTEEEPMKI

SEQ ID NO: 23801 - protein, 294 aa, Cryptosporidium parvum
MEKYQKLEKVGEGLTGLVYKAKDSQGRIVALKRIRLDAEDEGIPSTAIREISLLKELHHPNIVSLIDVIHSERCLTLVFEFMEKDLKKVLDEDKTGLQDSQIKIYLYQLLRGVAHCHQHRILHRDLKPQNLLINSDGALKLADFGLARAFGIPVRSYTHEVVTLWYRAPDVLMGSKKYSTSVDIWSIGCIFAEMITGKPLFPGVTDDDQLPKIFSILGTPNPREWPQVQELPLWKQRTFQVFEKKPWSSIIPGFCQEGIDLLSNMLCFDPNKRISARDAMNHPYFKDLDPQIMI

SEQ ID NO: 23802 - protein, 386 aa, Gossypium hirsutum
MDQVQHPSVMQKVAGQLFRSSHSQDFQGYNGSFRSPALYQRRAAYGNYSNAALQHPVRAFGDLSMVPSTASAICVQAPAEKGFSSFAIDFLMGGVSAAVSKTAAAPIERVKLLIQNQDEMIKSGRLSEPYKGIGDCFKRTIKDEGFGSLWRGNTANVIRYFPTQALNFAFKDYFKRLFNFKKDRDGYWKWFAGNLASGGAAGASSLLFVYSLDYARTRLANDAKAAKKGGERQFNGLVDVYRKTLKSDGIAGLYRGFNISCVGIIVYRGLYFGMYDSLKPVLLTGSMQDSFFASFVLGWLITNGAALASYPIDTVRRRMMMTSGKAVKYKSSLDAFSQILKNEGGKSLFKGAGSNILRAIAGAGVLAGYDKLQLIVFGKKYGSGGA

SEQ ID NO: 23803 - protein, 331 aa, Triticum aestivum
MTQNLGISVPIMSPSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQVCFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 23804 - protein, 331 aa, Triticum aestivum
MTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYGRTRLANDAKASKGGGDRQFNGLVDVYRKTLKSDGIAGLYRGFNISCVGIIVYRGLYFGLYDSLKPVLLTGTLQVCSFASFALGWLITNGAGLASYPIDTVRRRMMMTSGEAVKYKSSLDAFQQIPAKEGAKSLFKGAGANILRAIAGAGVLSGYDQLQILFFGKKYGSGGA

SEQ ID NO: 23805 - protein, 257 aa, Oryza sativa; identical to SEQ ID NO: 3100

SEQ ID NO: 23806 - protein, 971 aa, Candida albicans
MTSIYTSDLKNHRRAPPPPNGAAGSGSGSGSGSGSGSGSLANIVTSSNSLGVTANQTKPIQLNINSSKRQSGWVHVKDDGIFTSFRWNKRFMVINDKTLNFYKQEPYSSDGNSNSNTPDLSFPLYLINNINLKPNSGYSKTSQSFEIVPKNNNKSILISVKTNNDYLDWLDAFTTKCPLVQIGENNSGVSSSHPHLQIQHLTNGSLNGNSSSSPTSGLLSSSVLTGGNSGVSGPINFTHKVHVGFDPASGNFTGLPDTWKSLLQHSKITNEDWKKDPVAVIEVLEFYSDINGGNSAAGTPIGSPMINSKTNNNNNDPNNYSSTKNNVQEANLQEWVKPPAKSTVSQFKPSRAAPKPPTPYHLTQLNGSSHQHTSSSGSLPSSGNNNNNNSTNNNNTKNVSPLNNLMNKSELIPARRAPPPPTSGTSSDTYSNKNHQDRSGYEQQRQQRTDSSQQQQQQKQHQYQQKSQQQQQQPQQPLSSHQGGTSHIPKQVPPTLPSSGPPTQAASGKSMPSKIHPDLKIQQGTNNYIKSSGTDANQVDGDAKQFIKPFNLQSKKSQQQLASKQPSPPSSQQQQQKPMTSHGLMGTSHSVTKPLNPVNDPIKPLNLKSSKSKEALNETSGVSKTPSPTDKSNKPTAPASGPAVTKTAKQLKKERERLNDLQIIAKLKTVVNNQDPKPLFRIVEKAGQGASGNVYLAEMIKDNNRKIAIKQMDLDAQPRKELIINEILVMKDSQHKNIVNFLDSYLIGDNELWVIMEYMQGGSLTEIIENNDFKLNEKQIATICFETLKGLQHLHKKHIIHRDIKSDNVLLDAYGNVKITDFGFCAKLTDQRNKRATMVGTPYWMAPEVVKQKEYDEKVDVWSLGIMTIEMIEGEPPYLNEEPLKALYLIATNGTPKLKKPELLSNSIKKFLSICLCVDVRYRASTDELLEHSFIQHKSGKIEELAPLLEWKKQQQKHQQHKQETSDTGFA

SEQ ID NO: 23807 - protein, 747 aa, Mus musculus
MDIASPPTSKCITYWKRKVKSEYMRLRQLKRLQANMGAKALYVANFAKVQEKTQILNEEWKKLRVQPVQPMKPVSGHPFLKKCTIESIFPGFDSQDMLMRSLNTVALVPIMYSWSPLQQNFMVEDETVLCNIPYMGDEVKEEDETFIEELINNYDGKVHGEEEMIPGSVLISDAVFLELVDALNQYSDEEEDGHNDPSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHPVVSASCSNASASAMAETKEGDSDRDTGNDWASSSSEANSRCQTPTKQKASPAPAQLCVVEAPSEPVEWTGAEESLFRVFHGTYFNNFCSIARLLGTKTCKQVFQFAVKESLILKLPTDELMNPAQKKKRKHRLWAAHCRKIQLKKDNNSTQVYNYQPCDHPDRPCDSTCPCIMTQNFCEKFCQCSPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVF

SEQ ID NO: 23808 - protein, 746 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 23809 - protein, 384 aa, Lupinus luteus
MGLLCSRNRRYNDADAEENAQAAEIERRIELETKAEKHIQKLLLLGAGESGKSTIFKQIKLLFQTGFDEAELKSYLPVIHANVFQTIKLLHDGSKELAQNDVDSSKYVISDENKDIGEKLSEIGSKLDYPYLTTELAKEIETLWEDAAIQETYARGNELQVPGCAHYFMENLQRLSDANYVPTKEDVLYARVRTTGVVEIQFSPVGENKRSGEVYRLFDVGGQRNERRKWIHLFEGVSAVIFCAAISEYDQTLFEDENKNRMTETKELFEWILKQPCFEKTSFMLFLNKFDIFEKKILKVPLNVCEWFKDYQPVSTGKQEIEHAYEFVKKKFEELYFQSTAPERVDRVFKVYRTTALDQKLIKKTFKLVDESLRRRNLFEAGLL

SEQ ID NO: 23810 - protein, 147 aa, Pisum sativum
MGFTDKQEALVNSSWESFKQNLSGNSILFYTIILEKAPAAKGLFSFLKDTAGVEDSPKLQAHAEQVFGLVRDSAAQLRTKGEVVLGNATLGAIHVQRGVTDPHFVVVKEALLQTIKKASGNNWSEELNTAWEVAYDGLATAIKKAMT

SEQ ID NO: 23811 - protein, 247 aa, Streptomyces argillaceus
MARTTERALSVVVTGGGSGIGRATARAYAAQGAHVLVVGRTAGHLEETAEGQPRIRAFVADLADRDAPERIVAAALDATGGIDVLVNNAAVPWRARLGEIDRERAERQVATNLLGPLFLTQSAVPHMPAGATVVNISSNPPTRGWPANSVYGSTKVGLDFLTLTWAVELAPRGIRVVSVAPGPTLTPGLTRARSGQPPRQRDDFSRVPLGRPARPEEIAWWITQVTRQEAGYLTGAVLRVDGGLSVG

SEQ ID NO: 23812 - protein, 483 aa, Ralstonia sp. U2
MKTKLFINNTWSASSDKKSFDRKHPVSGEVVTQCANATVDDAVNAARAAQEAFKSWKAVGPSERRRLLLKVADVMESKTPEFIEVMAKEVGASALWAGFNVHLSANVFREAASLATQIQGETIPTDKPDTLSMTLRHAVGPILSIVPWNGTAVLAARAIAYPLVCGNTVVFKGSEFSPGTHALITKCLQEADLPAGVLNYLNSSPDRSPDIADALISSKEIRRINFTGSTRVGRIIAQKSAQHLKRCLLELGGKSPLIVLDDADIDAAVKAAVFGSFLFQGQICMSTERLVVDEKIADEFVAKFVEKTKQLSAGDPCVTGDCIIGPMVSPNSGDRINGLFKDAISKGAKVVCGGIAEGAVMPATILDHVTADMQIYDEETFGPITVVIRCKSEADAIRIANDSAYGLSSGVFGRDVNRALRVGMAIEYGSVHINGSTVQNEAQAPYGGTKATGYGRFDGRAVIDEFTELKWLTIEPFEQQYPF

SEQ ID NO: 23813 - protein, 474 aa, Tetragenococcus halophilus
MKSHPLTLTQNIMNNKGLNRYVITITLIATLGGLLFGYDTAVISGAEQSIQNNLVNGVGLGSFAHGLTVSSALIGCVFGGLLSGIFSNNLGRRNSLKLAGSLFLISALGSAYPEFLFFQAGDASVGLLIVFNLYRVLGGIGVGMASGISPTYIGEIAPGKVRGSLVSWYQFAIIFGQLVVYFVNWGIATGQSPEWVNDIGWRFMFASEAIPAILFFALLFYVPETPRYLVLKNNEEKAFDVLSKINNSKEEAKDILTDIKGSLNTTETSGKLFSYGKTVVIVGVLLSIFQQFIGINVALYYAPRIFESMGAGQNASMVQTIIMGIVNVTFTYVAIRTVDKWGRRPLLLVGSIGMAIGMFAVALLAKNGVLGIWTLVFIIVYTASYMMSWGPIVWVLLSEIFPNKIRGQAMAFAVAAQWLSNFFISSTYPAMIDFSGPLTYGFYGLMCVISAIFVWKMVPETKGKTLEQLENTWL

SEQ ID NO: 23814 - protein, 289 aa, Xenopus laevis
SLSSPLQSSASCKSPTNTKEERKFSVGSPVQPTRNGSTKPFSDAEKQRRHSLSSPLQSSASCKSPTNTKEERKFSAGSPLQPTRNGSTKPFSDAEKQGASGGQMGSPVDIHSPSSCLLGPCYLTGDSVRDKCVEMVASALKTDDDYKQFGTNCERLAWEIEECIYSEVKVTDMKYRNRIRSRISNLKDPKNPNLRKNVLCGVVTPQSIATMTAEEMASDELRELRNTMTQEAIREHQMAKTGGTQTDLLQCEKCKKKNCSYNQVQTRSADEPMTTFVLCNECGNRWKFC

SEQ ID NO: 23815 - protein, 121 aa, Xenopus laevis
KVTDMKYRNRIRSRISNLKDPKNPNLRKNVLCGVVTPQSIATMTAEEMASDELRELRNTMTQEAIREHQMAKTGGTQTDLLQCEKCKKKNCSYNQVQTRSADEPMTTFVLCNECGNRWKFC

SEQ ID NO: 23816 - protein, 300 aa, Rhizobium etli
MITVFGSINMDLIATTDRLPKPGETVAGNSFATAAGGKGANQALAARRAGRYVHMAGAVGKDGFAADALALLDDAGTDLSLVKHVDGPTGTALILVGGDGENMIAVVPGANGLVTAADAETAVGKMSEGDILMLQLEVPVDAVERALSEARVRGVTSILNLAPLTPDAPRLGRLADIVIANETEFERLAGQDGMDAEAREAALHRLHQETGQTLIVTLGGDGVIAIRNGVISRAQGLKIEPVDTVGAGDTFCGYFTASLDEGLRIFASALRRAAVAGSLACLKAGAQPSIPLSQDVADRI

SEQ ID NO: 23817 - protein, 110 aa, Haemonchus contortus
FYAVKCNTDRVLVRTLAALGTGFDCASREEIDIVMDLGVSAERIVYANPCKTRSFITHAKERNVSMMTFDSAEELAKVAQLHPQAKMILRIAVSDPTARCPLNLKFGADP

SEQ ID NO: 23818 - protein, 422 aa, Haemonchus contortus
MTMITQMELIGDSKVGIADGEVDALSMCRQIARNYDKDNIDEALCWSTDVVSTDSFVKRELPMIEPFYAVKCNTDRVLVRTLAALGTGFDCASREEIDIVMDLGVSAERIVYANPCKTRSFITHAKERNVSMMTFDSAEELAKVAQLHPQAKMILRIAVSDPTARCPLNLKFGADPVKMAPQLLVHAQELGVDVIGISFHVGSGCNDPTAYREALAHARHLIELGRGLGLDMTLVDLGGGYPGTPQQTSFEDIAAVIRSAVDEYLPPEFGVRLIAEPGRFFAAAPFTLVCNIIHATEVSAEKITKRPEDVEERGFMYYVNDGVYGSFNCILFDHVQPVGTPLFDEIAQEYPSTIWGPTCDSLDKIEDQKLMRMMSVGEWIVYRNMGAYTCSASTTFNGFQRPNAIYMINRKNWARISTSPNV

SEQ ID NO: 23819 - protein, 806 aa, Pisum sativum
MATDRLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLGTVAPDTPYSEFEHRFQEIGLERGWGDTAERVLESIQLLLDLLEAPDPCTLETFLDRIPMVFNVVILSPHGYFAQDDVLGYPDTGGQVVYILDQVRALESEMLNRIKKQGLDIVPRILIITRLLPDAVGTTCGQRLEKVYGTEHCHILRVPFRDQKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTETSRRLTSFYPEIEKLLYSTGGNEEHICVLKDRNKPIIFTMARLDRVKNITGLVEWYGKNAKLRELVNLVVVAGDRRKESKDLEEKAEMKKMYEHIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKTDPSHWDKISQGGLQRIEEKYTWQIYSQRLLTLTGVYGFWKHVSNLDRLESRRYLEMFYALKYRKLAESVPLAVEE

SEQ ID NO: 23820 - protein, 162 aa, Trema orientalis
MSSSEVDKVFTEEQEALVVKSWAVMKKNSAELGLKFFLKIFEIAPSANNLFSYLKDSPIPLEQNPKLKPHAMTVFVMTCESAVQFRKAGKVTVRESNLKRIGAIHFKNGVVHEHFEVTRFALLETIKEAVPEMWSPEMKNAWGEAYDQLVAAIKFEVKPSST

SEQ ID NO: 23821 - protein, 266 aa, Listeria monocytogenes
MKSRWRRMPKVSQPDKEAKEKVYIWIAAYQENGDQDAQYNLVVHYKNLVESIARKYSQGKSFHEDLVQVGNIGLLGAIRRYDATFGKSFEAFAVPTIVGEIKRFLRDKTWSVHVPRRIKELGPKIKNAVEELTRELQSSPQISDIADFIGVTEEEVLEAMEMGKSYQALSVDHSIEADSDGSTITLLDVVGGTDDGFERVNQRMLLEKVLPVLDEREQKILQFTFIENRSQKETGELLDISQMHVSRIQRQAIKKLREALQNEEVE

SEQ ID NO: 23822 - protein, 269 aa, Rhodococcus opacus
MASGWNLDGRTALVTGGSRGLGFSIAQALLERGAKVAIIARDDAAVKAAAGRLDSGAGAQNVLPIVADVADSDSIHEALAQVHEWQGRLDIVVNNAGPQLAPSPVTDADENVLTSAFDTKLLGFLRVSKAALPFLSQDGTGSIVNVAGATAHVPIPNTGVTGIVNASVVALTSFLATEAAAKNIRVNAISPGMTKTEGWLAKNDAAAQQQDKTADEIRAGVVQGLGIRLGRWAEPAEIGAAAAFLASDDASYITGQVLRVDGGLSKPVA

SEQ ID NO: 23823 - protein, 173 aa, Homo sapiens
DKKLQLIKDYREKVESELRSICTTVLELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 23824 - protein, 302 aa, Cimex lectularius
MKLLLSAGAALAFVLGLCAAGSPPAQLSVHTVSWNSGHERAPTNLEELLGLNSGETPDVIAVAVQGFGFQTDKPQQGPACVKNFQSLLTSKGYTKLKNTITETMGLTVYCLEKHLDQNTLKNETIIVTVDDQKKSGGIVTSFTIYNKRFSFTTSRMSDEDVTSTNTKYAYDTRLDYSKKDDPSDFLFWIGDLNVRVETNATHAKSLVDQNNIDGLMAFDQLKKAKEQKLFDGWTEPQVTFKPTYKFKPNTDEYDLSATPSWTDRALYKSGTGKTIQPLSYNSLTNYKQTEHRPVLAKFRVTL

SEQ ID NO: 23825 - protein, 685 aa, Calliphora vicina
MAAAAPAAAAAAPAAVATGGPKNIVEIAGEANITNYMKNRLRRGGMKRKGMQVVNGHKFVVRFFKQPTYCGHCKDFIWGFGKQGFQCEDCRFNIHQKCVSFVVFKCPGTETDIDADCAKVKHSWISTTYSSATFCDDCGLLLHGVAHQGVKCDNCNLNVHHGCKDKVPPLCGSDISEIRGKLLLYVEMKGNSLKVEIKEAANLIPMDTNGLSDPYVAVQLHPDRSGKTKKKTKTIQKNLNPVFNETFTFDITPPDREKRLLVEVWDWDRTSRNDFMGSFSFSLDEIQKEAIDGWYKFLSQVEGEHYNIPCSDPVPDIARLRDEVRREKPSNRPRIDNKDMPHNMSKRDMIRAADFNFIKVLGKGSYGKILLAERRGTDELYAVKVLRKDVIIQTDDMELPMIEKSILALPGKSPFLVSLHSCFQTMDRLFFVMEYCKGGDLLYHMQQYGRFKESVAIFYAVEVALALFFLHERRIIYRDLKLDNILLDVEGHVKLTDFGLSKDNVAEGDTTKTFCGTSSYMAPEIIMCEPYNHTVDWWAYGVFLYEMMAGQQPFEGDDDSTIFKNTKEKKAVFPKHFTQESMDIITSFLAKKPNNRLGAGRYARTEIQTHPFYQGVDWEAAEAVDWIDPPIVPHIKHRKDICNFDQNFTKEKTDLTPTDKLFMMNLDQNDFIGFSYMNPEFITMI

SEQ ID NO: 23826 - protein, 815 aa, Triticum aestivum; identical to SEQ ID NO: 4852

SEQ ID NO: 23827 - protein, 808 aa, Triticum aestivum
  unsure (1)..(808): unsure at all Xaa locations
MAAKLTRLHSLRERLGATFSSHPNELIALFSRYVHQGKGMLQRHQLLAEFDALFESDKEKYAPFEDILRAAQEAIVLPPWVALAIRPRPGVWDYIRVNVSELAVEELTVSEYLAFKEQLVDEHASSKFVLELDFEPFNASFPRPSMSNSIGKRVQFLNRHLSSQLFQDKESLYPLLNFLKAHYYKGTTMMLNDRIQSLRGLQSALRKAEEYLVSIPEDTPSSEFNHRFQELGLEKGWGDTAKRVHDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTDNGILRKWISRFDVWPYLETYTEDVANELMREMQTKPDFIIGNNSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVXPGADMTVYFPYTETDKRLTAFHSEIEELLYSDVENDEHKFVLKDRNKPIIFSMARLDRVKNMTGLVEMYGKNAHLKGFGKLVIVAGDHGKESKDREEQAEFKRMYSLIEEYKLKGHIRWISAQMNRVRNGELYRYICDTKGAFVQPAFYEAFGLTVIEVHECGLPTIATCHGGPAEIIVNGVSGLHIDPYHSDKAADILVNFFEKCSEDPSYWDKMSEGGLKRIYEKYTWKLYSERLMTLTGVYGFWKYVSNLERRETRRYLEMFYALKYRSLAAAVPLAVDGESSDN

SEQ ID NO: 23828 - protein, 161 aa, Trema orientalis
MSSSEVDKVFTEEQEALVVKSWAVMKKNSAELGLKFFLKIFEIAPSANNLFSYLKDSPIPLEQNPKLKPHAMTVFVMTCESAVQFRKAGKVTVRESNLKRIGAIHFKNGVVHEHFETRFALLETIKEAVPEMWSPEMKNAWGEAYDQLVAAIKFEVKPSST

SEQ ID NO: 23829 - protein, 301 aa, Homo sapiens [sequence omitted]

SEQ ID NO: 23830 - protein, 223 aa, Gallus gallus
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKTVSKKTGGKKGARKSKKKQGEVSKSASADSTTEGTPADGFTVLSTKSLFLGQKEALWKRKAARSLWKLSLSFGKRTGPWT

SEQ ID NO: 23831 - protein, 369 aa, Gallus gallus
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKTVSKKTGGKKGARKSKKKQGEVSKSASADSTTEGTPADGFTVLSTKSLFLGQKLQVVQADIATIDSDAVVHPTNSDFYTGGEVGSTLEKKGGKEFVEAVIELRKKNGPLDIAGAVVSAGHGLPAKFVIHCNSPGWGSDKCEELLEKTVKNCLALADEKKLKSIAFPSIGSGRNGFPKQTAAQLILKAISSYFVSTMSSSIKTVYFVLFDSESIGIYVQEMAKLDAN

SEQ ID NO: 23832 - protein, 372 aa, Gallus gallus
MSSRGGKKKSTKTSRSAKAGVIFPVGRMLRYIKKGHPKYRIGVGAPVYMAAVLEYLTAEILELAGNAARDNKKGRVTPRHILLAVANDEELNQLLKGVTIASGGVLPNIHPELLAKKRGSKGKLEAIITPPPAKKAKSPSQKKTVSKKTGGKKGARKSKKKQGEVSKSASADSTTEGTPADGFTVLSTKSLFLGQKLNLIHSEISNLAGFEVEAIINPTNADIDLKDDLGSTLEKKGGKEFVEAVIELRKKNGPLDIAGAVVSAGHGLPAKFVIHCNSPGWGSDKCEELLEKTVKNCLALADEKKLKSIAFPSIGSGRNGFPKQTAAQLILKAISSYFVSTMSSSIKTVYFVLFDSESIGIYVQEMAKLDAN

SEQ ID NO: 23833 - protein, 369 aa, Triticum aestivum; identical to SEQ ID NO: 4870

SEQ ID NO: 23834 - protein, 415 aa, Mus musculus
MLQKTVLLLALVAQVLMLENGLLRTPPMGWLAWERFRCNIDCVEDPKNCISERLFMEMADRLAQDGWRDLGYVYLNIDDCWIGGRDASGRLIPDPKRFPHGIAFLADYAHSLGLKLGIYEDMGKMTCMGYPGTTLDKVELDAETFAEWKVDMLKLDGCFSSSRERAEGYPKMAAALNATGRPIAFSCSWPAYEGGLPPKVNYTEVSRVCNLWRNYKDIQDSWKSVLSILDWFVRHQDVLQPVAGPGHWNDPDMLLIGNFGLSFDESRAQMALWTVLAAPLLMSTDLRTISPQNMDILQNPLMIKINQDPLGIQGRRILKSKSHIEVFKRYLSNQASALVFFSRRTDMPFRFHCSLLELNYPKGRVYEGQNVFTGDIFSGLQTEVNFTVIINPSGVVMWYLYPIKDLGISTMMSHW

SEQ ID NO: 23835 - protein, 252 aa, Homo sapiens
ADKQYKGIIDCVVRIPKEQGVLSFWRGNLANVIRYFPTQALNFAFKDKYKQIFLGGVDKRTQFWLYFAGNLASGGAAGATSLCFVYPLDFARTRLAADVGKAGAEREFRGLGDCLGKIYKSDGIKGLYQGFNVSVQGIIIYRAAYFGIYDTAKGMLPDPKNTHIVISWMIAQTVTAVAGLTSYPFDTVRRRMMMQSGRKGTDIMYTGTLDCWRKIARDEGGKAFFKGAWSNVLRGMGGAFVLVLYDEIKKYT

SEQ ID NO: 23836 - protein, 262 aa, Homo sapiens
LQVQHASKQIAADKQYKGIVDCIVRIPKEQGVLSFWRGNLANVIRYFPTQALNFAFKDKYKQIFLGGVDRHAFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 23837 - protein, 770 aa, Arabidopsis thaliana
MVAPALLLELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 23838 - protein, 89 aa, Pagrus major
VRNIASVCLEIGYPTLASVPHSVINGYKRVLAVAVETDYSFPLADKVKAFLADPSAFAVAAPAAAAETAAAPAAAKEEAKEESEESDDD

SEQ ID NO: 23839 - protein, 1478 aa, Saccharomyces cerevisiae
MPFLRKIAGTAHTHSRSDSNSSVKFGHQPTSSVASTKSSSKSPRATSRKSIYDDIRSQIPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESPLSPTKSGPSKTDEKIFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRSTPKPRVITMTEVSNTNPTEELNYWNIKEVLSHEENAPKMVFKTSPKLELNLPDKGSKLNIPTPITENESKSSFQVLRKDEGTEIDFNHRREAPYTKPEVAPKRESPKPPANTSPQRTLSTSKQNKPIRLVRASTKISRSKRSKPLPPQLLSSPIEASSSSPDSLTSSYTPASTHVLIPQPYKGANDVMRRLKTDQDSTSNSPSLKMKQKVNRSNSNVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 23840 - protein, 379 aa, Sorghum bicolor
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 23841 - protein, 515 aa, Pimpinella brachycarpa
MTSSLGDLLAQPNNDDFGSNWGFENQKTKSFANPSQPFSPPPVSPSSYFSFLDSPIQINNYNIVSSSGNGTMNAQSFNEENQNFSDFSFPTQSRPASSTSSSSFVPANTNSVEESLKRKQGGWNFEEAAKNNEFQRFSPEMTMNQANMLSPEMTMNQANMQSNAAVLQSNSINYAQSSQSSQTNRDQSKLDDGYNWRKYGQKQVKGSENPRSYYKCTYLNCPTKKKVETTFDGHITEIVYKGNHNHPKPQSTKRSSSQSYQNSIPTMPETSLLENGHLEPVTTPENSSLSFGEDDLFEQGSMNKQGDDDENEPDAKRWKGEYENNETMSSLGSRTVREPRIVVQTTSDIDILDDGYRWRKYGQKVVKGNPNPRSYYKCTQVGCPVRKHVERASHDLRAVITTYEGKHNHDVPAPRGSGSYAVNRPSDNTATTSAPTAIRPTTNYLNPLQNTRAQPANGQAPFTLEMLQRPRSYEFSGFGNSTNTYTINQNQQASGQFSTAKDEPDVDSFFDSFLA

SEQ ID NO: 23842 - protein, 444 aa, Lycopersicon esculentum
MAQSNSKPPMSSQNFGVGAVSHVRSLSQSSIFSNSCLPPLSPFPPSEPGMVSGHSSLKDISMEEADVNSQGVGVVSSFTRDGLPPRKGHRRSNSDVPLGFSAMIQSSPQLMPISGQKVLGRAVSLGDSNGKIDERKPKGEVTDELLFSYMNLENIETLNGSGTKDRDKDSIVSGTKVTGSESSNNEAESVMKGNNVSIQPTNLREGTKRSADANIAPAARHFRSLSMDSAIGNFHYGDESPNLPTSLMMRSGQLSPSNSGNESSSKHNLDFGNSEFSEAEMKKIMADERLAEIAVLDPKRAKRILANRLSAARSKERKTRYISELEHKVQKLQTETTTLSTQVTILQKNFVEISSLNSELKFRIQAMEQQAQLRDALHEALTAEVQRLKLAAGEHREEGRLPNNMTQQTPVKHNIFQMQRQQPSQMQQLSVGKASAASATPASA

SEQ ID NO: 23843 - protein, 154 aa, Lycopersicon esculentum
MGCPKLQSVLYFCRQMTNDALVSIARNRSNMIRFCLCIIEPQTPDYLILEPLDTGFGAIVQHCKEVQRLSLSGLLTDRVFEYIGVHAKKLEMLSLAFAGDSDIGLLYVLSGFESLRKLETRDCPFGDEALLANAAKLETMRSLWMSNCSVSFEA

SEQ ID NO: 23844 - protein, 220 aa, Escherichia coli
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERIT

SEQ ID NO: 23845 - protein, 301 aa, Anopheles gambiae
MTKKADPYGFAKDFLAGGISAAVSKTAVAPIERVKLLLQVQAASKQIAVDKQYKGIVDCFVRIPKEQGIGAFCGGNLANVIRYFPTQALNFAFKDVYKQVFLGGVDKNTQFWRYFLGNLGSGGAAGATSLCFVYPLDFARTRLGADVGPGAGEREFNGLLDCLKKTVKSDGIIGLYRGFNVSVQGIIIYRAAYFGCFDTAKGMLPDPKNTSIFVSWAIAQVVTTASGIISYPFDTVRRRMMMQSWPCKSEVMYKNTLDCWVKIGKQEGSGAFFKGAFSNVLRGTGGALVLVFYDEVKALLG

SEQ ID NO: 23846 - protein, 623 aa, Homo sapiens [sequence omitted]

SEQ ID NO: 23847 - protein, 377 aa, Mus musculus
AAAAPGGGGGEPRGTAGVVPVVPGEVEVVKGQPFDVGPRYTQLQYIGEGAYGMVSSAYDHVRKTRVAIKKISPFEHQTYCQRTLREIQILLRFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEGP

SEQ ID NO: 23848 - protein, 518 aa, Saccharum hybrid cultivar H65-7052
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNIMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPVDMPLEDGWGAAPASNNHK

SEQ ID NO: 23849 - protein, 354 aa, Cavia porcellus
MGCTLSAEDKAAVERSKMIDRNLREDGEKAAREVKLLLLGAGESGKSTIVKQMKIIHEAGYSEEECKQYKAVVYSNTIQSIIAIIRQMGRLKIDFGDSARADDARQLFVLAGAAEEGFMTAELAGVIKRLWKDSGVQACFNRSREYQLNDSAAYYLNDLDRIAQSNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYTGSNTYEEAAAYIQCQFEDLNKRKDTKEIYTHFTCATDTKNVQFVFDAVTDVIIKNNLKDCGLF

SEQ ID NO: 23850 - protein, 355 aa, Cavia porcellus
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPLRADDARQLFALSCTAEEQGMLPEDLSGVIRRLWADHGVQACFSRSREYQLNDSAAYYLNDLDRIAQSDYIPTQQDVLRTRVKTTGIVETHFTFKDLHFKMFDVGGQRSERKKWIHCFEGVTAIIFCVALSDYDLVLAEDEDMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 23851 - protein, 354 aa, Cavia porcellus
MGCTLSAEDKAAVERSKMIDRNLREDGEKAAKEVKLLLLGAGESGKSTIVKQMKIIHEDGYSEEECKQYKVVVYSNTIQSIIAIIRAMGRLKIDFGEPARADDARQLFVLAGSAEEGLMTSELAGVIRRLWRDGGVQACFSRSREYQLNDSASYYLNDLDRISQTNYIPTQQDVLRTRVKTTGIVETHFTFKDLYFKMFDVGGQRSERKKWIHCFEDVTAIIFCVALSDYTLVLAEDEEMNRMHESMKLFDSICMNKWFTDTSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 23852 - protein, 245 aa, Cyanothece sp. PCC 8801
MFGSIPLRHNHASSRGRPLEASTTALSDTSFESLTLWGNLKRDFQIIFRRDPAARNWLEVLCCYPGFHALALHRFSHWLWSHQVPFFPRFLSHLGRFFTGIEIHPGATIGQGVFIDHGMGVVIGETAIIGDNCLIYQNVTLGGTGKETGKRHPTLGNNVVVGAGAKVLGNLNIGDHVRIGAGSIVLRDVPSDCTVVGVPGRIISGSGRGCPLEHGKLPDIEAQVMRSLLDRIEQLEQKIQNLPSP

SEQ ID NO: 23853 - protein, 509 aa, Drosophila melanogaster
MAAPAACTRFSDNYDIKEELGKGAFSIVKRCVQKSTGFEFAAKIINTKKLTARDFQKLEREARICRKLHHPNIVRLHDSIQEENYHYLVFDLVTGGELFEDIVAREFYSEADASHCIQQILESVNHCHQNGVVHRDLKPENLLLASKAKGAAVKLADFGLAIEVQGDHQAWFGFAGTPGYLSPEVLKKEPYGKSVDIWACGVILYILLVGYPPFWDEDHDRLYSQIKAGAYDYPSPEWDTVTPEAKNLINQMLTVNPNKRITAAEALKHPWICQRERVASVVHRQETVDCLKKFNARRKLKGAILTTMLATRNFSSRSMITKKGEGSQVKESTDSSSTTLEDDDIKEDKKGTVDRSTTVVSKEPEAARRQEIIKITEQLIEAINSGDFDGYTKICDPHLTAFEPEALGNLVEGIDFHKFYFENVLGKNCKAINTTILNPHVHLLGEEAACIAYVRLTQYIDKQGHAHTHQSEETRVWHKRDNKWQNVHFHRSASAKISGATTFDFIPQK

SEQ ID NO: 23854 - protein, 530 aa, Drosophila melanogaster
MAAPAACTRFSDNYDIKEELGKGAFSIVKRCVQKSTGFEFAAKIINTKKLTARDFQKLEREARICRKLHHPNIVRLHDSIQEENYHYLVFDLVTGGELFEDIVAREFYSEADASHCIQQILESVNHCHQNGVVHRDLKPENLLLASKAKGAAVKLADFGLAIEVQGDHQAWFGFAGTPGYLSPEVLKKEPYGKSVDIWACGVILYILLVGYPPFWDEDHDRLYSQIKAGAYDYPSPEWDTVTPEAKNLINQMLTVNPNKRITAAEALKHPWICQRERVASVVHRQETVDCLKKFNARRKLKGAILTTMLATRNFSSRSMITKKGEGSQVKESTDSSSTTLEDDDIKEDKKGTVDRSTTVVSKEPEDIRILCPAKTYQQNIGNSQCSSARRQEIIKITEQLIEAINSGDFDGYTKICDPHLTAFEPEALGNLVEGIDFHKFYFENVLGKNCKAINTTILNPHVHLLGEEAACIAYVRLTQYIDKQGHAHTHQSEETRVWHKRDNKWQNVHFHRSASAKISGATTFDFIPQK

SEQ ID NO: 23855 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFNAEY

SEQ ID NO: 23856 - protein, 352 aa, Emericella nidulans
MADMSGEQMQAKITAARREAEGLKDKIRRRKDDLADTTLRDVAQNQTDALPRIGMKPRRTLKGHLAKIYAMHWSTDRRHLVSASQDGKLIIWDAYTTNKVHAIPLRSSWVMTCAYAPSGNYVACGGLDNICSIYNLSSREGPTRVARELSGHSGYLSCCRFINDRRIITSSGDMTCMLWDIESGSKVTEFADHFGDVMSISINPTNQNIFVSGACDAFAKLWDIRTGKAVQTFAGHESDINAIQFFPDGNAFGTGSDDTTCRLFDIRADRSLNTYQSDQILCGITSVGFSVSGRLLFAGYDDFECKVWDVLRGDKVGSLSGHENRVSCLGVSNDGISLCTGSWDSLLKVWAW

SEQ ID NO: 23857 - protein, 217 aa, Pimpinella brachycarpa
MVRGKTQMRRIENATSRQVTFSKRRNGLLKKAFELSVLCDAEVALIIFSPRGKLHEFASSSMHETIERYRKHTKDVQSNNTPVVQNMQHLKHETASLAKKIELLEVSKRKLLGEGLGTCSINELQQIEQQLEKSVCTVRARKMQVFKEQIEQLKEKEKTLAADNAILLAKYDVQPRQESPEDGGNLTSTTENSENSDVETELFIGPPEKRFKRIMEK

SEQ ID NO: 23858 - protein, 363 aa, Pisaster ochraceus
MNNPVTGSGETLSDDGYHRYELNKTTWEVPVQYQKLSAVGAGAYGSVCSSLNTKTGIKIAIKKLSRPFQSAIHAKRTYRELRLLQHMDHENIISLLDVFCRGDTLSSFRDVYMVTHLMGADLNSITKTQKLSDEHVQFLVYQILRGLKYIHSVGVIHRDLKPSNLAVNEDCELRILDFGLARQADDEMTGYVATRWYRAPEIMLNWMHYTNTVDMWSVGCIMAELLTGKTLFPGSDHIDQLSRIMDLTGTPDDEILAKIQSEDARNFVKSQPKTKKKDFRGYFAGANEIAVDLLEKMLLLDVDKRITAEEALSHPYVAKYHDESDEPIGKQFDDSFEQQDLTVQQWKELTFQLIQAVRHQSRR

SEQ ID NO: 23859 - protein, 730 aa, Mus musculus
MAKEKGLISPEDFAQLQKYIEYSTKRVSDVLKVFDDGEMNRFCQGDAIGYLGFEQFMKMYLEMEEVPHHLCWALFWSFHTSQVAAEKTKSKANVICLSDVYCYFTLLEGGRPEDKLEFTFKLYDMDRNGILDSTEVEKIILQMMRVAEYLDWDVSELRPILQEMMREMDQDGSGSVSLDEWVRAGATTVPLLVLLGMDVTMKDDGNHIWRPKRFTRLVYCNLCEQSISLGKQGLSCNFCKYIVHDHCAMKAQPCEVSTYAKSRKDIGVQSHLWVRGGCHSGRCDRCQKKIRTYHSLTGLHCVWCHLEIHDDCLQAVVPECDCGLLRDHILPPCSIYPSVLVSGQECKHKTTDDTSLCTPEAFRIEPVSNTHPLLVFINLKSGGKQGQSVLWNFQYILDPRQVFDLKDGPEPGLRFFKDVPQFRILVCGGDGTVGWVLETIDKANFATVPPVAVLPLGTGNDLARCLRWGRGYEGENLRKILKDIELSKVVYLDRWFLEVIPQQNGEKSDPVPSQIINNYFSIGVDASIAHRFHLMREKYPEKFNSRMKNKLWYFEFATSESIFSTCKKLEESVTVEICGKLLDLSDLSLEGIAVLNIPSTHGGSNLWGDTKRPHGDTCEINQALGSAAKIITDPDILKTCVPDMSDKRLEVVGIEGAIEMGQIYTRLKSAGHRLAKCSEITFQTTKTLPMQIDGEPWMQAPCTIKITHKNQMPMLMGPPSNSYNFFGFWS

SEQ ID NO: 23860 - protein, 369 aa, Rana japonica
MQTTKWRLRPAKKVGLLKPQHRNALGDIGNNLNRAKAALKKGSKALRTDVEKVAKPAPVEEEKPVPLSPMDTSGSSPMEAESEAFSDALLQVKDVDEDDADNPMLCSDYVKDIYCYLRDLEAERAVRPDYLKGQEITGNMRAILVDWLVQVHLRFKLLQETMFMTVSILDRFLQVNPVPKKSLQLAGVSAMFIASKYEEIYCPTIGDFSFVTDHTFTKSQIRNMEMQILTILNFDIGKPLPLHFLRRASKIGEVDAVLHTLAKYLIELSMVDYEMVHFPPSQVAAAAFCLSQKVLDGGEWTPTLQHYMGYSESSLIPSMRHLAKNVLKVNGGLTKFMSVRDKYAKSQQMRISCLPQLNSDFMVKLAKNV

SEQ ID NO: 23861 - protein, 151 aa, Rana japonica
GVVYKARNRETGEVVALKKIRLDTETEGVPSTAIREISLLKELSHPNIVKLLDVIHTENKLYLVFEFLNQDLKKFMDGSTIPGIPLALVKSYLFQLLQGLAFCHSHRVLHRDLKPQNLLINSDGAIKLADFGLARAFGVPVRTYTHEVVTL

SEQ ID NO: 23862 - protein, 249 aa, Bufo japonicus
LLDIKDVDADDYDNPMLCSEYVKDIYLYLHQLEITQAVKPKYLEGKEITGNMRAILIDWLVQVQIKFRLLQETMYMTVAIIDRFLQDHPVPKKQLQLVGVTAMFIASKYEEMYPPEIADFAFVTDRAYTTGQIREMEMKIRRVLDFSFGRPLPLQFLRRASKIGDVTAEHHTLAKYFLELTMVDYEMVHFPPSQVRSAAYALTLKVFNCGDWTPTLQHYMGYTEDALVPVMQHIAKNVVRLNEGLSKHL

SEQ ID NO: 23863 - protein, 249 aa, Cynops pyrrhogaster
LIEVKDVDAGDAENPMLCSAYVKDIYNYLRNLEEEQSVRPRYLDGQEVTGNMRAILVDWPVQVQMKFRLLQETMFMTVGIIDRFLQANPVPKKMLQLVGVTAMFVACKYEEMYPPEIGDFAFVTDHTYTKAQIREMEMKILRVLDFGLGRPLPLHFLRRASKIGEVSSEQHTLAKYLMELVMVDYDMVHFPPSQVAAAAFCLALKVLDGGEWTPTLEHYMCYSEGSLTPVMQHMAKNILKVNRGLTKHL

SEQ ID NO: 23864 - protein, 254 aa, Prunus armeniaca
MAPQALSLAPLALSLVLFNLHLHGAFADYGGWEGAHATFYGGGDASGTMGGACGYGNLYSQGYGTNTAALSTALFNNGLSCGSCYEMRCNNDPRWCRPGSIIVTATNFCPPNFAQSNDNGGWCNPPLQHFDLAEPAFLQIAQYRAGIVPVTFRRVPCMKKGGIRFTINGHSYFNLVLITNVGGAGDVHSVSIKGSRTGWQPMSRNWGQNWQSNNYLNGQSLSFQVTTSDGRTVTSYNVAPGNWQFGQTFSGGQF

SEQ ID NO: 23865 - protein, 252 aa, Prunus armeniaca
MAFTSHLAIALLFSVLNLCLQGTYGDYGGGWEGGHATFYGGGDASGTMGGACGYGNLYSQGYGTNTAALSTALFNDGLSCGSCYEMRCDSDPKWCLPGSIIVTATNFCPPNLAQSNDNGGWCNPPLQHFDLAEPAFLQIAQYRAGIVPISFRRVSCVKKGGIRFTINGHSYFNLVLITNVGGAGDVHSVSIKGSKTGWQAMSRNWGQNWQSNSYLNGQALSFQVTTSDGRTVTSNAVPADWQFGQTFSGGQF

SEQ ID NO: 23866 - protein, 271 aa, Xenopus laevis
VINCKAAIAWGPKQPLTIEDIEVAPPKAHEVRVKIVATGICRSDDHVLSGAISDMKFPAILGHEGAGIVESVGEGVKNLKPGDKVIPLFVPQCGECRCCTNSRSNLCDKHDIGPYIGLLLDRTSRFTCKGKPVYNFLSTSTFTEYTVLDEICVAKIDDNAPLEKVCLIGCGFSTGYGSAVNTAKVEPGSSCAVFGLGGVGLSVLIGCKVAGAAKIIGVDTNPDKFAKAKELGATDCINPNDYKEPIHEVLAKMSDGGLDYTFECIGNTKVM

SEQ ID NO: 23867 - protein, 271 aa, Xenopus laevis
VIHCKAAVALEAKKPLVIQQIEVAPPKAKEIRIKIYHSGICHTDDHALGGFMAGIKFPIILGHEGAGVVESVGEGVTSVEPGDHVIAICSPMCMKCPSCLHPDSNFCVQNDVGKNVGMMLDKTSRFSINGKMIHNFMSTSTFCEYTVLDEFACVKIDCKAPLYEVCLIGCGFSTGYGSVLNTAKVQQGSSCAVFGLGGIGMSAVMGCKVAGASRIIGVDINKGKFEIAKKLGCTECLDPNDYDKPIHEVIAEMTNGGVDYSFECVGKVELM

SEQ ID NO: 23868 - protein, 1042 aa, Populus x canescens
MAGLVTGSSQTLHAKDELMPPTRQSATSKKCRVCGDEIGVKEDGEVFVACHVCGFPVCRPCYEYERSEGNQSCPQCNTRYKRHKGCPRVPGDNDDEDANFDDFDDEFQIKHHDHDESNQKNVFSHTEIEHYNEQEMHPIRPAFSSAGSVAGKDLEGDKEGYSNAEWQERVEKWKVRQEKRGLVSKDEGGNDQGEEDEYLMAEARQPLWRKIPIPSSRINPYRIVIVLRLIILCFFFRFRILTPASDAYALWLISVICEVWFGLSWILDQFPKWNPIERETYLDRLSMRFEREGEPNRLGPVDVFVSTVDPLKEPPIITANTVLSILSVDYPVDKVSCYVSDDGASMLLFDSLAETAEFARKWVPFCKKHNIEPRAPEFYFTQKIDYLKDKVHPNFVKERRAMKREYEEFKVRINALVSKAQKKPEEGWVMQDGTPWPGNITRDHPGMIQVYLGSEGALDVEGKELPRLVYVSREKRPGYNHHKKAGAMNALILVSAVLTNAPFMLNLDCDHYINNSKAVREAMCFLMDPQLGKKLCYVQFPQRFDGIDRHDRYANRNVVFFDINMKGLDGVQGPVYVGTGCVFNRQSLYGYDPPVSEKRPKMTCDCWPSWCCCCFGGSRKKSKKKGQRSLLGGLYPMKKKMMGKKYTRKASAPVFDLEEIEEGLEGYEELEKSSLMSQKSLEKRFGQSPVFIASTLMENGGVPEGTNSQSHIKEAIHVISCGYEEKTEWGKEVGWIYGSVTEDILTGFKMHCRGWRSVYCSPKRPAFKGSAPINLSDRLHQVLRWALGSIEIFLSHHCPLWYGYGGKLKLLERLAYINTIVYPFTSIPLLAYCTTPAVCLLTGKFIIPTLNNLASIWFPGPFHLNHSNICVGVGWSGVSIQDLGRNEQFWVIGGVSGHLFAVFQGFFKVLGGVDTNFTVTSKSADDAEFGELYLFKWTTLLIPPTTLIILNMVGVVAGVSARINNGYGSWGPLFGKLFFAFWVIVHLYPFLKGLMGKQNRTPTIVVLWSVLLASIFSLIWVRIDPFLPKQTGPILKQCGVEC

SEQ ID NO: 23869 - protein, 54 aa, Leavenworthia crassa
FNVINGGSHAGNKLAMQEFMILPVGASSFKEAMKMGVEVYHNLKSVIKKKYGQD

SEQ ID NO: 23870 - protein, 54 aa, Leavenworthia uniflora
FNVINGGSHAGNKLVMQEFMILPVGASSFKEAMKMGVEVYHNLKSVIKKKYGQD

SEQ ID NO: 23871 - protein, 54 aa, Leavenworthia crassa
FNVINGGSHAGNKLAMQEFMILPVGASTFKEAMKMGVEVYHNLKSVIKKKYGQD

SEQ ID NO: 23872 - protein, 303 aa, Candida parapsilosis
MATDSNFLIDFLMGGVSAAVAKTAAAPIERVKLLIQNQDEMLKQGRLSHKYTGIIDCFRRTAADEGIVSFWRGNTANVIRYFPTQALNFAFKDQIKALFGFKKDEGYWKWFAGNLASGGIAGALSLAFVYSLDYARTRLANDAKSAKGDGKGREFNGLIDVYKKTLASDGIAGLYRGFGPSVIGIVVYRGLYFGLYDSLKPVVLVGPLEGSFLASFLLGWVVTTGASTASYPLDTIRRRMMMTSGQAVKYDGALDCARKVVAAEGVKSLFKGCGANILRGVAGAGVISLYDQLQVLLFGKKFK

SEQ ID NO: 23873 - protein, 389 aa, Mus musculus
MYGRKVGFALDLPPRRRDEDMLYSPELAQRGHDDDMSSTSEDDGYPEDMDQDKHDDSTEDSDTDRSDAESDGDEFGHREDSERDNTEEKKSGLSVRFADMPGKSRKKKKNMKELTPLQAMMLRMAGQEIPEEGREVEEFSEEEDADDSDDSEAEKQSQKQHKDDAHSDSTAAASSQQQAPPQSAPASQIQAPPMPGPPPLGPPPAPPLRPPGPPTGLPPGPPPGAPPFLRPPGMPGIRGPLPRLLPPGPPPGRPPGPPPGPPPGLPPGPPPRGPPPRLPPPAPPGIPPPRPGMMRPPLVPPLGPAPPGLFPPAPLPNPGVLSAPPSLIQRPKADDASAATIEKKATATISAKPQITNPKAEVTRFVPTALRVRRENKGATAVPQKKVRG

SEQ ID NO: 23874 - protein, 147 aa, Stentor coeruleus
MRILSHVNGFSTQEKLSKLEDIKRNIRDAILTICDAMEKLNVSLENEQLRPKLDWIIDHASETKFLISPEFWEYTEELWKDKGIQQCYERSNEYQLIDCAKYFLDKVKLIISPGYVPDEQDILRCRVHTSGIFETTFTVDKVCFYMF

SEQ ID NO: 23875 - protein, 143 aa, Stentor coeruleus
  unsure (1)..(143): unsure at all Xaa locations
MKILYLRRISAAERKMFKEIIYRTPFXVSALVLAAERGFDLQFLPENAHTRVFKTNNILFEQELSPEIVTAAHGAVVDPAIKTTYKRSNEFQLNDSAAYFLSQIERLASADYIPTEPDILHARRTTGITETVFTLEGNTFRLV

SEQ ID NO: 23876 - protein, 220 aa, Gossypium barbadense
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 23877 - protein, 887 aa, Oryza sativa (indica cultivar-group); identical to SEQ ID NO: 4078

SEQ ID NO: 23878 - protein, 264 aa, Homo sapiens [sequence omitted]

SEQ ID NO: 23879 - protein, 415 aa, Fusarium oxysporum
MALTAAQVAIVKSTAPILKEHGKTITTTFYRNMLGAHPELKNYFSLRNQQTGAQQAALANSVLAYATYIDDLGKLSHAVERIAHKHVSLFIKPEHYPIVGTHLIGAIGEVLGSALTTEIKDAWVAAYGQLADIFIQREGQMYEAAGEWNSWRKFKIVKKEAENDSVTSFYLEPTDGKPLPKFLPGQYVSVQIPIPELDGLLQSRQFSLSEAPGTNHYRISVKLQGPTEEPAVEDLAAGKIAGLLSTRLHNRYNVGDEVELSPPAGEFSLDPADTSAAKKPLVLLSAGVGATPLVSILDSVLQSPTASRPITWIHGARYSGSTCFVPHVLDSAKKHENITAKIFLEDVKEGDQYDFKGEIDLAKLQKEQLLQLDNADAEYYICGPEDWMVNVRAFLEENGVPRERQHLELFKTGDI

SEQ ID NO: 23880 - protein, 329 aa, Homo sapiens
LFVNPKWGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPC

SEQ ID NO: 23881 - protein, 210 aa, Homo sapiens
SIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSGITFHTTKTLPMQIDGEPWMQTPCTIKITHKKQMPMLMGPPPRSTNFFGFLS

SEQ ID NO: 23882 - protein, 567 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVPASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESI

SEQ ID NO: 23883 - protein, 153 aa, Nicotiana clevelandii
MKMIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKSLLDLTCQTVADMIKGKTPEEIRKTFNIKNDFTPEEEEEVRRENAWAFE

SEQ ID NO: 23884 - protein, 372 aa, Hemerocallis hybrid cultivar
STEIFSPVRIRSLAAVRQEEVKLMITGILASTSTDNSVKVNMKVVFSELMFNVIMKIIAGKRYFGVNTDSEVEEGQKFRVVFDEMFSTLEVASPQDFLPFLKWFGFKRMENRLTKLAKELDQLFQKLIEERRSERGKVQSTVIDVLLSLQETDREQYSDKLIKGMILSLIAAGTHTTAGTMEWAMSLLLNHPEALLKVRDEIDKKVGQDRLIDHSDLQNLSYLNNAIKESLRLFPTAPLLLAHESSAECTVGGFTIPSNTILFANAYALHRDPKVWTDPVSFKPERFENNGQQGSRIYVPFGLGRRSCPGEGLATQVVGLALGTLIQCFEWDRNGEEKVDMTDGSGLAMHMEKPLEAMCKPRQSIVDVINRL

SEQ ID NO: 23885 - protein, 215 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 23886 - protein, 220 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 23887 - protein, 217 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGV

SEQ ID NO: 23888 - protein, 218 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVD

SEQ ID NO: 23889 - protein, 217 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVD

SEQ ID NO: 23890 - protein, 219 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 23891 - protein, 213 aa, Gossypium hirsutum
GYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 23892 - protein, 370 aa, Homo sapiens [sequence omitted]

SEQ ID NO: 23893 - protein, 518 aa, Oryctolagus cuniculus
MVSDFGLPTFISATELLLASAVFCLVFWVAGASKPRVPKGLKRLPGPWGWPLLGHVLTLGKNPHVALARLSRRYGDVFQIRLGSTPVVVLSGLDTIKQALVRQGDDFKGRPDLYSFSFVTKGQSMIFGSDSGPVWAARRRLAQNALNSFSVASDPASSSSCYLEEHVSQEAENLISKFQELMAAVGHFDPYRYVVMSVANVICAMCFGRRYDHDDQELLSLVNLNDEFGKVAASGSPADFFLILRYLPNPALDTFKDLNERFYSFTQERVKEHCRSFEKGHIRDITDSLIKHYRVDRLDENANVQVSDEKTVGIVLDLFGAGFDTVTTAISWSLMYLVTKPSIQRKIQEELDAVVGRARRPRFSDRPQLPYLEAVIMETFRHTSFLPFTIPHSTTRDTSLGGFYIPKGRCVFVNQWQNNHDPELWGDPEPFRPERFLTPSGAVDKALTEKVLLFGLGKRKCIGETIGRLEVFLFLATLLQQVEFSVSPGTTVDMTPIYGLTMKHARCEHFQAKLRFEA

SEQ ID NO: 23894 - protein, 354 aa, Xenopus laevis
MGCTLSAEERAALERSKQIEKNLKEDGVTAAKDVKLLLLGAGESGKSTIVKQMKIIHEDGFSGEDVKQYKPVVYSNTIQSLAAIVRAMDTLGIEYGDKERRADAKMVCDVVSRMEDTEPYSPELLSAMVTLWADSGIQECFNRSREYQLNDSAKYYLDSLDRIGAPDYQPTEQDILRTRVKTTGIVETHFTFKNLHFRLFDVGGHRSERKKWIHCFEDVTAIIFCVALCGYDQVLHEDETTNRMHESLMLFDSICNNKFFIDTSIILFLNKKDLFAEKIKKSPLSICFPEYTGSNTYEDAAAYIQAQFESKNRSPNKEIYCHMTCATDTNNIQVVFDAVTDIIIATTLRGCGLY

SEQ ID NO: 23895 - protein, 350 aa, Xenopus laevis
MGCTSSAEDKAAAERSKMIDKNLREDGEKAAREVKLLLLGAGESGKSTIVKQMKIIHEDGYSEEECRQYRAVVFSNTIQSIMAIIKAMGNLKIDFGDSARADDARQLFALSCSAEEQGVLPEDLSGVIRRLWADHGVQACFNRSREYQLNDSAAYYLNDLERIARSDYLPTQQDVLRTRVKTTGIVETHFTFKDLHFKMFDVGGQRSERKKWIHCFEGVTAIIFCVALSAYDLVLAEDEEMNRMHESMKLFDSIWNNKWFTETSIILFLNKKDLFEEKITHSPLTICFPEYTGANKYDEAASYIHSKFEDLNKRKDTKEIYTHFTCATDTKNVEFVFDAVTDVIIKNNLK

SEQ ID NO: 23896 - protein, 354 aa, Bos taurus
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSPELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDFICNNKFFIDTSIILFLNKKDLFGEKIKKSPLTICFPEYTGSNTYEDAAAYIQAQFESKNRSPNKEIYCHMTCATDTNNIQVVFDAVTDIIIANNLRGCGLY

SEQ ID NO: 23897 - protein, 469 aa, Capsicum chinense
PIPVPVFGNWLQVGDDLNHRNLTDYAKKFGDIFLLRMGQRNLVVVSSPESAKEVLHTQGVEFGSRTRNVVFDIFTGKGQDMVFTVYGEHWRKMRRIMTVPFFTNKVVQQYRGGWESEVASVVEDVKKNPESATNGIFLRKRLQLMMYNNMFRIMFDRRFESEDDPLFVKLRALNGERSRLAQSFEYNYGDFIPIFRPFLRGYLKICKEVKEKRLQLFKDYFVDERKKLANTKSMDSNALTCAIHHILDAQQKGEINEDNVLYIVENINVAAIQTTLWSIEWGIAELVNHPHIQQKLREEIDTVLGPGVQVTEPDTQKLPYLQAVIKETLRLRMAIPLLVPHMSLHDAKLAVYDIPAESKILVNAWWLANNPAHWKKPEEFRPERFLEEEKHVDANGNDFRFLPFGVGRRSCPGIILALPILGITLGRLVQNFEMFPPPGQSKLDTSEKGGQFSLHILKHSTIVMKPRSF

SEQ ID NO: 23898 - protein, 768 aa, Cucurbita moschata
MSVTILPDLGTEIFIPVCAVIGIVFSLVQWYYVSQVKLSPGRDAAHNNSAGSKNGYSDYLIEEEEGVNDHNVVIKCAEIQSAISEGATSFLFTEYKYVGIFMVLFAVLIFVFLGSVESFSTKPQPCTYDKTRTCKPALATAIFSTVSFLLGAVTSVVSGFLGMKIATYANARTTLEARKGVGKAFITAFRSGAVMGFLLAANGLLVLFIAINLFKLYYGDDWGGLFESITGYGLGGSSMALFGRVGGGIYTKAADVGADLVGKVERNIPEDDPRNPAVIADNVGDNVGDIAGMGSDLFGSYAESSCAALVVASISPFGNNHELTPMLYPLIVSSMGILVCLITTLFATDFFEIKAVKEIEPALKKQLIISTVLMTFGIAIVTWLSVPSSFTIFNFGTQKVVTNWKLFLCVAVGLWAGLIIGFVTEYYTSNAYSPVQDVADSCRTGAATNVIFGLALGYKSVIIPIFAIAVSIFVSFTFAAMYGIAVAALGMLSTIATGLAIDAYGPISDNAGGIAEMAGMSHRIRERTDALDAAGNTTAAIGKGFAIGSAALVSLALFGAFVSRAGVTAVDVLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGASKHARTLGPKGSDPHKAAVIGDTIGDPLKDTSGPSLNILIKLMAVESLVFAPFFASHGGLLFKIF

SEQ ID NO: 23899 - protein, 294 aa, Pisum sativum
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFSKDQRQVKMFLYQILCGIAYCHSHRVLHRDLKPQNLLIDRSSNALKLADFGLARAFGIPVRTFTHEVVTLWYRAPEILLGSRHYSTPVDVWSVGCIFAEMINQRPLFPGDSEIDELFKIFRITGTPNEDTWPGVTSLPDFKSAFPKWPSKDLATLVPSLEPSGLDLLSSMLRLDPSRRITARGALEHEYFKDIKFVP

SEQ ID NO: 23900 - protein, 522 aa, Arabidopsis thaliana
MGSTDEPRSSMHGVTGREQSYAFSVDGSEPTNTKKKYNLPVDAEDKATVFKLFSFAKPHMRTFHLSWISFSTCFVSTFAAAPLIPIIRENLNLTKHDIGNAGVASVSGSIFSRLVMGAVCDLLGPRYGCAFLVMLSAPTVFSMSFVSDAAGFITVRFMIGFCLATFVSCQYWMSTMFNSQIIGLVNGTAAGWGNMGGGITQLLMPIVYEIIRRCGSTAFTAWRIAFFVPGWLHIIMGILVLTLGQDLPGGNRAAMEKAGEVAKDKFGKILWYAVTNYRTWIFVLLYGYSMGVELSTDNVIAEYFFDRFHLKLHTAGIIAACFGMANFFARPAGGWASDIAAKRFGMRGRLWTLWIIQTSGGLFCVWLGRANTLVTAVVSMVLFSLGAQAACGATFAIVPFVSRRALGIISGLTGAGGNFGSGLTQLVFFSTSRFTTEEGLTWMGVMIVACTLPVTLIHFPQWGSMFFPPSNDSVDATEHYYVGEYSKEEQQIGMHLKSKLFADGAKTEGGSSVHKGNATNNA

SEQ ID NO: 23901 - protein, 434 aa, Dreissena polymorpha
MNTRAASANLAGRMALQQINSDNIDQIPGKAQLLQRPQTSHLMQRNTLSDIGNQVSAITISDASKKGPIKKEIVQVNPRQQKALTKTKATTSLKALAEKKETKKEHDEFHFVEPSFPSRIPVPTATVHPLPSAHVPMDTSDAGKDAFSKALLNVQGIDANGRGNPQLVSEYVNDIYEYMRILEKKYPIADSYLEKQEISGKMRAILIDWLCQVHHRFHLLQETLYLTVGIIDRFLQESPVTKNKLQLVGVTSMLIASKYEEMYAPEVADFVYITDNAYTKKEILEMEQTILRTLNFSFGKPLCLHFLRRNSKAGQVDASKHTLAKYLMELTIVEYDMVQYLPSQIAAAALCLSMKLLGDCKWTETLAHYSSYTEEELVPTMRKLASLVMKQEDSKLKLTAIRTKYSSSKFMKISTIPALKSPLVQELAGASDCS

SEQ ID NO: 23902 - protein, 419 aa, Dreissena polymorpha
MSQFAIHQDVENQVPRRGKAANTRTVTQGQKRAVLGVITNQANQPNRVQPSRAAKPKVPETVQDENAFAKENWKILGQTGQFSVFVDEQTKPVSKAPKSTELPSVLTAVPHTRLPLDQVPCSPEIICLDDSVESPMVLDIQEDEKKPFDREAVILTAPEYEEDIYSYLREAEAKNRAKPGYMKRQQDITSSMRSILVDWLVEVAEEYKLHRETLFLAVNYIDRFLSKISVLRGKLQLVGAASMFLAAKYEEIYPPDVTEFAYITDDTYDKKQILRMEHLILKVLAFDVAIPTTNWFCESFLKSIDAEEKLKSLTMFLSELTLIEMDSYLKYVPSITASACICLARYSLGLEPWPQSLVKKTGYEVGHFVDCLKELHKTYQAAESHPQQAVQEKYKQDKFQQVSDFTKNPVPHSLTLLAV

SEQ ID NO: 23903 - protein, 523 aa, Streptomyces coelicolor A3(2)
MDIRHRSRPFGEGVMTANVDRMPEKFATLGLTYDNVLLLPGASAGASRNAVEHLVPGISPQRCGFNIPGCSPAAMDKVDRVPELAISMARQGGVGVPCTATLSIEGTRPTRSTWLKRSESGMVANPITIHPDSTLAEADALCAKFRISGVPVTDGAGKLLGIVTNRDMAFETDRSRQVREVMTPMPLVTGQVGISGVEAMDLLRRHKIEKLPLVDGDGILKGLITVKDFVKAEQYPHAAKDAKGRLLVGAAVGASPEALDRAQALAEAGVDFLVVDTSHGHNSNALSSISKNESSVGIDVVGGNVATRDGAQALIDAGVDGIKVGVGPGSICTPRVVAGIGVPQVTAIYEASLAARAAGVPLIGDGGLHYSRDIGKALAAGADSVMLGTLLAGCPGVPGELHFINGKQFKSYRRMGSLGALQSLGQAGGHFKDRYFQAQVASDDKLVPEGIEGQVPYRGPLANVLHQLVGGLRPRRWATVGAATIEEMESKGRFVRITSAGRPESHPHDIQMTVEAPNYSRSK

SEQ ID NO: 23904 - protein, 257 aa, Oryza sativa (japonica cultivar-group); identical to SEQ ID NO: 3624

SEQ ID NO: 23905 - protein, 271 aa, Oryza sativa (japonica cultivar-group); identical to SEQ ID NO: 3125

SEQ ID NO: 23906 - protein, 999 aa, Malus x domestica
MLLFLPLLLLLLLPPLPTTLSLNQEGLYLRHFKLSLDDPDSALSSWNYADSTPCNWLGVTCDDASSSSPVVRSLDLPSANLAGPFPTVLCRLPNLTHLSLYNNSINSTLPPSLSTCQTLEDLDLAQNLLTGALPATLPDLPNLKYLDLSGNNFSGAIPDSFGRFQKLEVLSLVYNLIENTIPPFLGNISTLKMLNLSYNPFHPGRIPAELGNLTNLEVLRLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIARATNLSLLILAKNKFSGPIPEEIGWVENLMEFSGGDNKFSGPLPESIVRLGQLGTLDLHSNEVSGELPVGIQSWTNLNELNLASNQLSGKIPDGIGNLSVLNYLDLSGNRFSGKIPFGLQNMKLNVFNLSYNQLSGELPPLFAKEIYRNSFLGNPGLCGDLDGLCDSRAEVKSQGYIWLLRCMFILSGLVFVVGVVWFYLKYKNFKKVNRTIDKSKWTLMSFHKLGFSEYEILDCLDEDNVIGSGASGKVYKVVLNSGEVVAVKKLWRRKVKECEVEDVEKGWVQDDGFEAEVDTLGKIRHKNIVKLWCCCTARDCKLLVYEYMQNGSLGDLLHSSKGGLLDWPTRFKIALDAAEGLSYLHHDCVPAIVHRDVKSNNILLDGDFGARVADFGVAKEVDATGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDTSDHGSVA

SEQ ID NO: 23907 - protein, 533 aa, Oryza sativa; identical to SEQ ID NO: 1207

SEQ ID NO: 23908 - protein, 759 aa, Azotobacter vinelandii
MLNTLRKIVQEVNSAKDLKTALGIIVRRVKEAMGSQVCSVYLLDPETNRFVLMATDGLNKRSIGKVSMASNEGLVGLVGTREEPLNLENAAAHPRYRYFAETGEERYASFLGAPIIHHRRVMGVLVVQQKERREFDEGEEAFLVTMSAQLAGVIAHAEATGSIRGLGRQGKGIQEARFVGVPAAPGVAVGKAVVVLPPADLDVVPDKPAEDLKAELELFGNALEAVRADIRALSAKLATQLRPEERALFDVYLMMLDDASLGCEVQRVIRTGQWAQGALRQVVNEHVKRFELMDDAYLRERASDVKDLGRRLLAYLQQARQQAMVYADNTILVSEELSSAMLGELPEGKLVGLVSVQGSGNSHVAILARAMGIPTVMGVVDLPYSKMDGIDLIVDGYHGEVYTNPSDMLRQQFADLVEEERQLTQGLDALRELPCETLDGHRLPLWVNTGLLADVARAQERGAEGVGLYRTEVPFMNNERFPSEKEQLAIYRDQLSAFYPLPVTMRTLDIGGDKSLSYFPIKESNPFLGWRGIRVTLDHPEIFLVQVRAMLKASEGLNNLRVLLPMISSIHELDEALHLIHRAWGEVRDEGTDVPMPPVGVMVEIPAAVYQTRELARLVDFLSVGSNDLTQYLLAVDRNNPRVADLYDYLHPAVLQALNKVVQDAHAEGKPVSICGEMAGDPSAAVLLMAMGFDSLSMNATNLPKVKWLLRQITLSKARELLDRLMAIDNPQVIHSTLQLALRNLGLGRVINPVASLQS

SEQ ID NO: 23909 - protein, 110 aa, Cicer arietinum
QAYESVRDAFKRLTQNLRSAEGVAIFDTCYDLSSLRSVRVPTVSFHFGNDRVWDLPAKNYLIPVDSDGTFCFAFAPTSSSLSIIGNVQQQGTRVSFDIANSLVGFSPNKC

SEQ ID NO: 23910 - protein, 82 aa, Mus musculus
GGNVVTAAQAKNLIDAGVDALRVGMGSGSICITQEVLACGRPQATAVYKVSEYARRFGVPVIADGGIQNVGHIAKALALGAF

SEQ ID NO: 23911 - protein, 131 aa, Mus musculus
ITMMRRDVRGHLENNPALEKMLAHIRWNVVFVFTKEDLTEIRDMLVANKVPAAARAGAIAPCEVTVPAQNTGLGSYKTSFVQVLGITTMISRGSIDFLIDVQMIKDGDMVAASYATLLNILFTSRYSPGFY

SEQ ID NO: 23912 - protein, 366 aa, Emericella nidulans
MTSQRPTSSSSSLLDIVANLASPKSLLFNAHHTNPPPSLPSQRAPTMDKSQQPSSFQQLEKLGEGTYATVFKGRNRQTGELVALKEIHLDSEEGTPSTAIREISLMKELKHESIVSLYDVIHTENKLMLVFEYMDKDLKKYMDTRGDRGQLDQATIKSFMHQLMSGIAFCHDNRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAGYGGMMPPQQAY

SEQ ID NO: 23913 - protein, 320 aa, Emericella nidulans
MDKSQQPSSFQQLEKLGEGTYATVFKGRNRQTGELVALKEIHLDSEEGTPSTAIREISLMKELKHESIVSLYDVIHTENKLMLVFEYMDKDLKKYMDTRGDRGQLDQATIKSFMHQLMSGIAFCHDNRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAGYGGMMPPQQAY

SEQ ID NO: 23914 - protein, 239 aa, Malus x domestica
MGRGRVQLKRIENKINRQVTFSKRRTGLLKKAHEISVLCDAQVALIVFSNKGKLFEYATDSCMEQILERYERYSYAERQLVEPDFESQGNWTFEYSRLKAKAEVLQRNHRHYLGEDLDSLTLKEIQNLEQQLDTALKQIRLRKNQLMNESISELQRKRKAIQEENNLLAKKIKEKEKAAAQPQVQNWEQQNHGLDLLPQPLPCLNNGGTQQDEFLQVRRNQLDLTLEPLYECHLGCFAA

SEQ ID NO: 23915 - protein, 245 aa, Malus x domestica
GKVELKRIENKSNRQVTFSKRRNGLLKKAFELSVLCDAEVALIIFSGRGKLYEFSSSLSMMKTLERYQRCSYSSLDANRPANETQNSYQEYLQLETRVEALQQSQRNLLGEDLATLNTKKLEELEHQLETSLNKIRSTKTQFMLDQLSDLQNREQMLVEANKALRRKLEETSVQAPQFMAWEAAGDGHNNIQQTWLPSNSEAFFHPFGGNNSTSQIGYAHLGSHNGMDVGNPGQHVNGYIPGWML

SEQ ID NO: 23916 - protein, 248 aa, Malus x domestica
MGRGRVELKRIENKINRQVTFAKRRNGLLKKAYELSVLCDAEVALIIFSSRGKLYEFCSSFSMMKTLEKYQSCSYGSLEANLPANETQNSYQDYLMLKARVEVLQQSQRNLLGEDLSHLNTKELEHLEHQLETSLKQIRSRKTQFILDQLSDLQNREQMLVEANKALKRKLEETSVHAPEGMAWEAAGHGPNNIQQTRLPSHSEAFFHPLEGNNSSSQIGYTHMGSDNEMNVGNPGQYVNGYIPGWML

SEQ ID NO: 23917 - protein, 246 aa, Malus x domestica
MGRGRVELKRIENKINRQVTFAKRRNGLLKKAYELSVLCDAEVALIIFSNRGKLYEFCSSSSILKTLDRYQKCSYGAVDQVNRPAKELESSYREYMKLKGRYESLQRTQRNLLGEDLGPLNTKELEQLERQLEGSLKQVRSTKTQYMLDQLSDLQNKEQLLIEANRDLTMKLDEISSRNQLRQSWEGGDQGMAYATQHHHAQSQGFFQPLDCNPTLQMGYSAVGSEQMSATTNAQQVNCFIPGWML

SEQ ID NO: 23918 - protein, 242 aa, Malus x domestica
RVELKRIENKINRQVTFAKRRNGLLKKAYELSVLCDAEVALIVFSNRGKLYEFCSSPSILQTVDRYQKCSYGAVDQVNIPAKELESSYREYMKLKGRCESLQRTQRNLLGEELGPLNTKELEQLERQLEASLKQVRSTKTQYMLDQLSALQNKEQLLIEANRDLTMKLDEIGSRNQLRQSWEGGDQGMAYGTQHHHAQSQGFFQPLDCNPTLQIGYPAEGSEQMGATTHAQQVNCFIPGWML

SEQ ID NO: 23919 - protein, 243 aa, Malus x domestica
MGRGRVELKRIENKINRQVTFSKRRNGLLKKAYELSVLCDAEVGLIIFSSRGKLYEFASAGMSKTLERYQRCSFTPPENSIERETQSWYQEVTKLKAKYESLQRTQRHLLGEDLGPLSVKELQNLEKQLEGALAQTRQRKTQLMIEQMEDLRKKERHLGDLNKQLRVKLEAEGQNLNVIQNMWSSDAAAGSSNFSLHSSQTNPMDCTPEPVIQMGYHQYHPAEGSSIPRSLTGETNFIQGWVL

SEQ ID NO: 23920 - protein, 616 aa, Pseudomonas tolaasii
MSGKAQQQSRIKELIVLGREQGYLTYAEVNDHLPEDISDPEQVEDIIRMINDMGINVFEAAPDKDSLMLADADTDEAAAEEAAAALAAVKTDIGRTTDPVRMYMREMGTVELLTREGEIGIAKRIEEGIREVMGAIAHFPGTVDRILSEYNRVTTEGGRLSDVLSGYIDPDDGIAPPAAEVPPPVDAKAAKADDDSEDDDAESSGDDEDEVESGPDPIIAAQRFGAVSDQMEITRKALKKHGRTNKQAIAELIALAELFMPIKLVPKQFEGLVERVRSALERLRAQERAIMQLCVRDARMPRADFLRQFPGNEVDESWTDALAKGKAKYAEAIGRLQPDIIRCQQKLTALETETGLTIAEIKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIDVATVESLKEATRDVLSGLTAREAKVLRMRFGIDMNTDHTLEEVGKQFDVTRERIRQIEAKALRKLRHPTRSEHLRSFLDE

SEQ ID NO: 23921 - protein, 178 aa, Brassica napus
MENMGTRVIEPLIVGRVVGDVLDNFTPTIKMNVSYNKKQVSNGHELFPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 23922 - protein, 178 aa, Brassica napus
MENMGTRVIEPLIVGRVVGDVLDNFTPTIKMNVSYNKKQVSNGHEFLPLAVSSKPRVEIHDGDLRSFFTLVMTDPDVPNPSDPFLKERLPWLVMNIPGTTDAAFGKEVVSYELPKPNIGIHRYVFVLFRQKQRRVKFPSNIISRDQFNTREFAIENDLGLPVAAVFFNAQRETASRRR

SEQ ID NO: 23923 - protein, 178 aa, Brassica napus
MENMGTRVIEPLIVGRVVGDVLDNFAPTIKMNVSYNKKQVSNGHELFPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 23924 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 23925 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASCRR

SEQ ID NO: 23926 - protein, 177 aa, Brassica oleracea
ENMGTRVIEPLIVGRVVGDVLDNFTPTIKMNVSYNKKQVSNGHELFPLAVSSKPRVETHDGDLRSFFTQVMTDPDVPNPSDPFLKERLHRLVMNIPGTTDATLGKEVVSYELPKPNIGIHRYVFVLFRQKQRRVKFPSNIISRDQFNTREFAIENDLGLPVAAVFFNAQRETASRRR

SEQ ID NO: 23927 - protein, 177 aa, Brassica oleracea
ENMGTRVIEPLIVGRVVGDVLDNFTPTIKMNVSYNKKQVSNGHELFPLAVSSKPRVEIHDGDLRSFFTLVMTDPDVPNPSDPFLKGRLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 23928 - protein, 805 aa, Lycopersicon esculentum
MAERVLTRVHRLRERVDATLAAHRNEILLFLSRIESHGKGILKPHELLAEFDAIRQDDKDKLNEHAFEELLKSTQEAIVLPPWVALAIRLRPGVWEYVRVNVNALVVEELSVPEYLQFKEELVDGASNGNFVLELDFEPFTASFPKPTLTKSIGNGVEFLNRHLSAKMFHDKESMAPLLEFLRAHHYKGKTMMLNDRIHNSNTLQNVLRKAEEYLIMLPPETPFFEFEHKFQEIGLEKGWGDTAERVLEMVCMLLDLLEAPDSCTLEKFLGRIPMVFNVVILSPHGYLAQENVLGYPDTGGQVVYILDQVPALEREMLKRIKEQGLDIIPRILIVTRLLPDAVGTTCGQRLEKVYGTEHSHILRVPFRTEKGIVRKWISRFEVWPYMETFIEDVAKEISAELQAKPDLIIGNYSEGNLAASLLAHKLGVTQCTIAHALEKTKYPDSDIYWKKFDEKYHFSSQFTADLIAMNHTDFIITSTFQEIAGSKDTVGQYESHMAFTMPGLYRVVHGINVFDPKFNIVSPGADINLYFPYSESEKRLTAFHPEIDELLYSDVENDDHLCVLKDRTKPILFTMARLDRVKNLTGLVEWYAKNPRLRGLVNLVVVGGDRRKESKDLEEQAEMKKMYELIETHNLNGQFRWISSQMNRVRNGELYRYIADTKGAFVQPAFYEAFGLTVVEAMTCGLPTFATNHGGPAEIIVHGKSGFHIDPYHGEQAADLLADFFEKCKKEPSHWETISTGGLKRIQEKYTWQIYSERLLTLAAVYGFWKHVSKLDRLEIRRYLEMFYALKYRKMAEAVPLAAE

SEQ ID NO: 23929 - protein, 110 aa, Lycopersicon esculentum
MEEEKHHHHHLFHHKDKAEEGPVDYEKEIKHHKHLEQIGKLGTVAAGAYALHEKHEAKKDPEHAHKHKIEEEIAAAAAVGAGGFAFHEHHEKKDAKKEEKKAEGGHHHLF

SEQ ID NO: 23930 - protein, 431 aa, Lycopersicon esculentum
MAGQTVIVSGLNPAAILQSTIGGAPVAAAAENGHTRKVVPLSKDALQDFMVSIITQKLQDDKQPFYVLDLGEVVSLMEQWNSALPNIRPFYAVKCNPEPSFLSMLSAMGSNFDCASRAEIEYVLSHGISPDRIVFANPCKPESDIIFAEKIGVNLTTYDSEDEVYKIRKHHPKCELLLRIKPMTDGNARCPMGPKYGALPEEIEPLLRTAQAARLTVSGVSFHIGSGDADSNAYLGAIAAAKQVFETAAQLGMPKMTVLDIGGGFTSGHQFTTAAPAVKSALETHFHDFPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLIFPNMGAYTKAAGSNFNGFNTSAIVTHLAYAYPN

SEQ ID NO: 23931 - protein, 489 aa, Gallus gallus
MATITCNRFTEEYQLFEELGKGAFSIVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHHNGVVHRDLKPENLLLASKLKGAAVKLADFGLAIEVEGDQQAWFGFAGTPGYLSPEVLRKDPYGKAVDLWACGVILYILLVGYPPFWDEDQHRLYQQIKAGAYDFPSPEWDTVTPEAKDLINKMLTINPSKRITAAEALKHPWISHRATVASCMHRQETVDCLKKFNARRKLKGAILTTMLATRNFSGGKSGGNKKNDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYVDVGGIPRTAQSEETRIWHRRDGKWQIVHFHRSGAPSVLPQ

SEQ ID NO: 23932 - protein, 540 aa, Gallus gallus
MATTVPCTRFTDEYQLYEEIGKGAFSVVRRCVKLCTGHEYAAKIINTKKLSARDHQKLEREARICRLLKHSNIVRLHDSISEEGFHYLVFDLVTGGELFEDLVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPDWDTVTPEAKNLINQMLTINPAKRITAHEALKHPWVCQRSTVASMMHRQETVECLKKFNARRKLKGAILTTMLATRNFSVGRQTTAPPSMSAAAAPLGLVEQAKSLLNKKADGVKPQTNSTKGSAGVTSPKGTLPPAALEPQTTVIHNPADGIKESSDSTNTTIEDEDTKARKQEIIKITEQLIEAVNNGDFEAYAKICDPGLTSFEPEALGNLVEGMDFHRFYFENLLSKNNKPIHTTILNPHVHVIGEDAACIAYIRLTQYLDAQGRPRTSQSEETRVWHRRDGKWQNVHFHGSGAPVAPLQ

SEQ ID NO: 23933 - protein, 270 aa, Emericella nidulans
MATNARYEPAPQRDSFEDQHYTQAPPSYQATAQEPTPRSEDDNVPDDFKFGGTVAEGTLPIRMQFIRKVYAILTVQLLLTTVMSSISFFSPSYCEWIRSNVWLMMVSVFGAFGFLLVTYWKRKSYPANLLFLSAFTILEAYSISVVTSYYQPRIVVQALILTLGLFVGLTLFACQTKYDFTNWMPYLFGALWFLILFGFVAAFVPHGSTMELIYGSLAALIFSGYILVDTQLIMRHYHVEEEIAASISLYLDILNLFLAILRILNNQNNN

SEQ ID NO: 23934 - protein, 591 aa, Brassica napus
MPTWWVRKSSKNKDDSHLLQTQTRSVSDKSIRRISADNSKSSPDPVTPSRCTPRCSREFAGASGFSDEKKCHPLPLPSLSNDQVNGSVSGSGSVSSVSSSGSGEDQSQPTAPRKSNAAAASPKAGARPTSPLHNRFSGMTLESSSTGRNDDGRSSEYHPLPLPPGSPTSPSVVLPCSPTSPSSGVQGSWVVGGSEKEISKWKKGRFIGSGTFGKVYQGFNSEEGRICAIKEVKVISDDKNSKECLKQLNQEINVLSQLCHPNIVQYYGSELSEETLSVYLEFVSGGSIYKLLTEYGAFTEPVIQNYTRQILYGLAYLHGRNTVHRDIKGANILVDPNGEIKLADFGMAKHVTAYSTMLSFTGSPYWMAPEVVMHKNGYTLAVDVWSVGCTILEMATAKPPWSQFEGVAAIFKIGNSKDMPEIPDHLSNDAKNFIRLCLQRNPTVRPTAAQLLEHPFLRVHSPRVANTSMHKDVPPRPYDGSSSMPTREPPYSGRHPVFHPIKSPSRENVRAITSLPVSPCSSPLRQLGPAYKSCFLSPPHPSYAFPVQESGYNHQAEFAASPFRFKKDTSLIEPSSYRAQAPSSPFRSRLV

SEQ ID NO: 23935 - protein, 406 aa, Lycopersicon esculentum
VEVWPYVETFIEDVGKEITAELQAKPDLIIGNYSEGNLAASLLAHKLGVTQCTIAHALEKTKYPDSDIYLNKFDEKYHFSAQFTADLIAMNHTDFIITSTFQEIAGSKDTVGQYESHMAFTMPGLYRVVHGIDVFDPKFNIVSPGADVNLYFPYSEKEKRLTTFHPEIEDLLFSDVENEEHLCVLKDRNKPIIFTMARLDRVKNLTGLVEWYAKNPRLRELVNLVVVGGDRRKESKDLEEQAEMKKMYELIKTHNLNGQFRWISSQMNRVRNGELYRCIADTRGAFVQPAFYEAFGLTVVEAMSCGLPTFATNQGGPAEIIVHGKSGFQIDPYHGEQAADLLAEFFEKCKVDPSHWEAISKGGLKRIQEKYTWQIYSDRLLTLAAVYGFWKHVSKLDRLEIRRYLG

SEQ ID NO: 23936 - protein, 244 aa, Triticum aestivum; identical to SEQ ID NO: 5198

SEQ ID NO: 23937 - protein, 229 aa, Triticum aestivum; identical to SEQ ID NO: 5135

SEQ ID NO: 23938 - protein, 374 aa, Glycine max; identical to SEQ ID NO: 2564

SEQ ID NO: 23939 - protein, 203 aa, Nicotiana tabacum
HEETWGELPLKVDDSEDMVIYTLLKDALNVGWSPFNFTAGEVKSELMEEEIVVSPADTTAAPAAELPRGRHYRGVRRRPWGEFAAEIRDPAKNGARVWHRTYETDEEAAIAYDKAAYRMRGSKAHLNFPHRIGLNEPEPVRVTAKRRASPEPASSSENSSAKRRRKAVAAEKSGAVEVESKSNVLQVGCQVELLTRGHQLLVS

SEQ ID NO: 23940 - protein, 348 aa, Drosophila melanogaster
MSRRRAHDTEDEGYDHRRNKRRRVSENQEIEDRLESLILRVGERSTSSVESNLEGLVSVLEADLGTFRLKILRILSDCAVRMPEKCTVYTTLVGLLNAKNYKFGGEFVDHMVKTFKESLKMCRWDAARYSLRFLADLVNCHVISATSLLQLLDTMIDVSNEDTVPQVRRDWFVFAVLSTLPWVGRDLYEKKESALESLLLRIEVYLNKRSKKHHNALRVWSSDAPHPQEEYLDCLWAQIRKLRQDNWAEKHIPRPYLVFDSILCEALQHNLPTIVPPPHHDNFEYPMPWVVYRMFDYTDCPDGPNLPGAHSIERFLIEEHLHHIIETYHHERKDCAAQLLSFPYKHKI

SEQ ID NO: 23941 - protein, 459 aa, Petunia x hybrida
MMRRIKSIASGRSSVSDPGGDLNLKRAKVEQDVDNMVDGETQSEERCSIANKQDVSSKSKRSTASTLNVDNELPKELNEMKIRDEKSGDHEDDTKDMEPAVVSGNGTETGQIIVTTMSGRNGQKKQTLSYMAERVVGTGSFGVVFQAKCLETGESVAIKKVLQDRRYKNRELQMMRMLEHPNVVKLRHCFYSTTEKNEVYLNLVLEYVSETVYRVSRHYSRVNHHMPIIYVQLYTYQLCRALNYMHNVVGVCHRDIKPQNLLVNPHTHQLKICDFGSAKMLVPGEPNISYICSRYYRAPELIFGATEYTTAIDMWSAGCVFGELLLGQPLFPGESGVDQLVEIIKILGTPTREEIRCMNPNYKEFKFPQVKAHPWHKIFNRRIPSEAVDLASRMLQYSPTLRCTALEACAHPFFDALREPNASLPNGRPLPPLFNFTPQELSGAPTELRQRLIPEHARK

SEQ ID NO: 23942 - protein, 172 aa, Arabidopsis thaliana
PMSTVRKITLKSSDGENFEIDEAVALESQTIKHMIEDDCTDNGIPLPNVTSKILSKVIEYCKRHVEAAEKSETTADAAAATTTTTVASGSSDEDLKTWDSEFIKVDQGTLFDLILAANYLNIKGLLDLTCQTVADMIKGKTPEEIRKTFNIKNDFTPEEEEEVRRENQWAFE

SEQ ID NO: 23943 - protein, 254 aa, Gibberella zeae
PGVGFGTFANEGAKGETYKAVIAALKTGYRHLDCAWFYLNEGEVGQAVRDFLAEDNGVKREDLFICTKVWNHLHEPEEVKWSFENSLKNFGLDYIDLFLVHWPIAAEKGDDYQPKIGPDGKYVIKKDLTENPEPTWRAMEEIYASGKARAIGVSNWTIDGLKQLMAFAKVKPAVNQIEIHPFLPNEDLVKFCLENDILPAAYSPLGSQNQVPTTGETVRSNKTLNEVADRSGNTLAQVLIAWGLRRGTLFCPRA

SEQ ID NO: 23944 - protein, 87 aa, Xenopus laevis
KRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 23945 - protein, 805 aa, Lycopersicon esculentum
MAQRVLTRVHSLRERLDATLDAHRNEILLFLSRIESHGKGILKPHQLLAEFESIQKEDKDKLNDHAFEEVLKSTQEAIVLPPWVALAIRLRPGVWEYVRVNVNALSVEELTVPEFLQFKEELVNGTSSDNFVLELDFEPFTASFPKPTLTKSIGNGVEFLNRHLSAKMFHDKESMTPLLEFLRVHHYNGKSMMLNDRIQNLYTLQKVLRKAEEYLTTLSPETSYSSFEHKFQEIGLERGWGDTAERVLEMICMLLDLLEAPDSCTLEKFLSRIPMVFNVVIPSPHGYFAQENVLGYPDTGGQVVYILDQVPALEREMLKRIKEQGLDIKPRILIVTRLLPDAVGTTCGQRLEKVFGTEHSHILRVPFRTEKGIVRKWISRFEVWPYMETFIEDVGKEITAELQAKPDLIIGNYSEGNLAASLLAHKLGVTQCTIAHALEKTKYPDSDIYLNKFDEKYHFSAQFTADLIAMNHTDFIITSTFQEIAGSKDTVGQYESHMAFTMPGLYRVVHGIDVFDPKFNIVSPGADVNLYFPYSEKEKRLTTFHPEIEDLLFSDVENEEHLCVLKDRNKPIIFTMARLDRVKNLTGLVEWYAKNPRLRELVNLVVVGGDRRKESKDLEEQAEMKKMYELIKTHNLNGQFRWISSQMNRVRNGELYRYIADTRGAFVQPAFYEAFGLTVVEAMSCGLPTFATNQGGPAEIIVHGKSGFQIDPYHGEQAADLLAEFFEKCKVDPSHWEAISKGGLKRIQEKYTWQIYSDRLLTLAAVYGFWKHVSKLDRLEIRRYLEMFYALKFRKLAELVPLAVE

SEQ ID NO: 23946 - protein, 806 aa, Pisum sativum
MATDRLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLGTVAPDTPYSEFEHRFQEIGLERGWGDTAERVLESIQLLLDLLEAPDPCTLETFLDRIPMVFNVVILSPHGYFAQDDVLGYPDTGGQVVYILDQVRALESEMLNRIKKQGLDIVPRILIITRLLPDAVGTTCGQRLEKVYGTEHCHILRVPFRDQKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTETSRRLTSFYPEIEELLYSTVENEEHICVLKDRSKPIIFTMARLDRVKNITGLVEWYGKNAKLRELVNLVVVAGDRRKESKDLEEKAEMKKMYEHIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKTDPSHWDKISQGGLQRIEEKYTWQIYSQRLLTLTGVYGFWKHVSNLDRLESRRYLEMFYALKYRKLAESVPLAVEE

SEQ ID NO: 23947 - protein, 259 aa, Solanum tuberosum
MAVAPTAREENVYMAKLAEQAERYEEMVEFMEKVSNSLGSEELTVEERNLLSVAYKNVIGARRASWRIISSIEQKEESRGNEEHVNSIREYRSKIENELSKICDGILKLLDSKLIPSATSGDSKVFYLKMKGDYHRYLAEFKTGAERKEAAESTLTAYKAAQDIASAELAPTHPIRLGLALNFSVFYYEILNSPDRACNLAKQAFDEAIAELDTLGEESYKDSTLIMQLLRDNLTLWTSDMQDDGADEIKEDPKPEEKN

SEQ ID NO: 23948 - protein, 288 aa, Plasmodium berghei
MEKYHGLEKIGEGTYGVVYKAQNSDGESFALKKIRLEKEDEGIPSTAIREISILKELRHSNIVKLYDVIHAKKRLILVFEQLDQDLKKLIDVCDGGLESVTAKSFLLQLLNGIAYCHEHRVLHRDLKPQNLLINREGELKIADFGLARAFGIPARRYTHEVVTLWYRAPDILMGSKKYSTPIDIWSVGCIFAEMVNGRPLFPGASETDQLMRIFKILGTPNSQNWPDVFKLPKYDPNFPVYNPLPWETFIKGLDDTGIDLLSKMLKLDPNQRITAKYTIEHPYFKETN

SEQ ID NO: 23949 - protein, 288 aa, Plasmodium knowlesi
MEKYHGLEKIGEGTYGVVYKAQNNYGETFALKKIRLEKEDEGIPSTAIREISILKELKHSNIVKLYDVIHTKKRLILVFEHLDQDLKKLLDVCDGGLESVTAKSFLLQLLSGIAYCHEHRVLHRDLKPQNLLINREGELKIADFGLARAFGIPVRKYTHEVVTLWYRAPDILMGSKKYSTPIDIWSVGCIFAEMVNGRPLFPGVSETDQLMRIFRILGTPNSANWPSVTELPKYDPDFIVYEPLPWETFLKGLDDTGIDLLSKMLRLDPNQRITAKEALQHAYFKESS

SEQ ID NO: 23950 - protein, 386 aa, Cucumis sativus
MDPETLSATLFKWEPREMVGGGSGAPLPAPLPPYSLRPRELGLGGLEDLFQAYGIRYYTAAKIAELGFTVSTLVDMKDEELEDMMNSLSHIFRWDLLVGERYGIKAAVRAERRRLDDEIESSRRRHLLSNDTTTNVVLDALSQEGPSEEPVQQEKEAVGSGGGGGAWEAVVAAEMRKKQRRRNGSKKKQVIAMEEDNDENEGAGDEEENMEVSERQREHPFIVTEPGEVARGKKNGLDYLFHLYEQCREFLIQVQNIAKERGEKCPTKVTNQVFRYAKKAGASYINKPKMRHYVHCYALHCLDEEASNALRSVFKERGENVGAWRQACYKPLVTIAGTQGWDIDAIFNAHPRLAIWYVPTKLRQLCHAERNGSTASTSTASAHLPF

SEQ ID NO: 23951 - protein, 249 aa, Solanum tuberosum
MALPENLTREQCLYLAKLAEQAERYEEMVKFMDKLVIGSGSSELTVEERNLLSVAYKNVIGSLRAAWRIVSSIEQKEEGRKNDEHVVLVKDYRSKVESELSDVCAGILKILDQYLIPSASAGESKVFYLKMKGDYYRYLAEFKVGNERKEAAEDTMLAYKAAQDIAVAELAPTHPIRLGLALNFSVFYYEILNASEKACSMAKQAFEEAIAELDTLGEESYKDSTLIMQLLRDNLTLWTSDMQEQMDEA

SEQ ID NO: 23952 - protein, 564 aa, Solanum tuberosum
MGSCFSSSKVSGSNSNTPSTNNTATNTNTTVNVHPNRRETSKAPSTTVVNSRNQEGSNYNRGKGNINQKNQQKQPRNSQQNVKPSSRRQGGVIPCGKRTDFGYDKDFEKRYTIGKLLGHGQFGYTYVATDKSSGDRVAVKRIEKNKMVLPIAVEDVKREVKILKALGRHENVVQFYNSFEDHNYVYIVMELCEGGELLDDCQKTVGIREDAAIVVPQMLKVAAECHLHGLVHRDMKPENFLFKSTKEDSPLKATDFGSSDFIRPGKVQDIVGSAYYVAPEVLKRRSGPESDVWSIGVITYILLCGRRPFWDKTEDGIFKEVLRNKPDFRRKPWSNISNSAKDFVKKLLVKDPRARLTAAQALSHPWVREGGDASEIPLDISVLSNMRQFVRYSHLKQFALRALRSTLDEEEIADLRDQFSAIDVDKNGVISLEEMRQALAKDLPWKMKESRVLEILQAIDSNTDGLVDFPEFVAATLHVHQLEEHNSAKWQQRSQAAFEKFDVDRDGFITPEELKMHTGLRGSIDPLLEEADIDKDGKISISEFRRLLRTASMTSPTVRDSRGM

SEQ ID NO: 23953 - protein, 463 aa, Chlamydomonas reinhardtii
MTQSRVEQNLQRVNELKAEATTLERMRKASDLDIKERERIAISTVAAKGPASSSSSAAAVSAPATSATLTVERPAATTVTQEVPSTSYGTPVDRAPRRSKAAIRRSRGLESSMEIEEGLRNFWYPAEFSARLPKDTLVPFELFGEPWVMFRDEKGQPSYIRDECAHRGCPLSLGKVVEGQVMCPYHGWEFNGDGACTKMPSTPFCRNVGVAALPCAEKDGFIWVWPGDGLPAETLPDFAQPPEGFLIHAEIMVDVPVEHGLLIENLLDLAHAPFTHTSTFARGWPVPDFVKFHANKALSGFWDPYPIDMAFQPPCMTLSTIGLAQPGKIMRGVTASQCKNHLHQLHVCMPSKKGHTRLLYRMSLDFLPWMRHVPFIDRIWKQVAAQVLGEDLVLVLGQQDRMLRGGSNWSNPAPYDKLAVRYRRWRNGVNAEVARVRAGEPPSNPVAMSAGEMFSVDEDDMDN

SEQ ID NO: 23954 - protein, 350 aa, Ambystoma tigrinum
MGAGASAEAKHSRELEKKLKEDAEKDARTVKLLLLGAGESGKSTIVKQMKIIHQDGYTKEECMEFISIINSNTLQSMLAIVRAMNTLNIGYGDPARQDDSRKLMHLADTIDEGQMPKEMSDIIARLWKDSGIQACFDRASEYQLNDSASYYLNDLERLVKPGYVPTEQDVLRSRVKTTGIIETQFGLKDLNFRMFDVGGQRSERKKWIHCFEGVTCIIFIAALSAYDMVLVEDDEVNRMHESLHLFNSICNHRYFAATSIVLFLNKKDVFTEKIKKAHLSICFPDYDGPNTYEDAGNYIKQQFLELNMRRDIKEIYSHMTCATDTENVKFVFDAVTDIIIKENLKDCGLF

SEQ ID NO: 23955 - protein, 354 aa, Ambystoma tigrinum
MGSGASTEDKELAKRSKELEKRLQEDADKDAKTVKLLLLGAGESGKSTIVKQMKIIHQDGYTEQECLEFKSIIYGNILQSILSIIRAMTTLGIDYASNQRAEDGRLLCHLADSIEEGTMPKELVDVIKRLWKDEGVQACFERAAEYQLNDSAPYYLNELDRITTPTYLPNEQDVLRSRVKTTGIIETQFSFKDLHFRMFDVGGQRSERKKWIHCFEGVTCIIFCGALSAYDMVLVEDDEVNRMHESLHLFNSICNHKFFAATSIVLFLNKKDLFEQKIKKVHLSICFPDYDGPNTYDDAANYIKLQFLDLNMRKDIKEIYGHLTCATDTKNVKFVFDAVTDIVIKETLKDCGLF

SEQ ID NO: 23956 - protein, 167 aa, Brassica napus
MAETEQKEVEEKGSLISGLLDKAKGFSAEKLANIPTPEATVDDVDFKGVARQGVDYHAKVSVKNPYPQAIPICQQSYILKSDTRMISVLARLPDPGSLIERVDGSWTVPVKVPYSIAVSLMKDMCLDWDIDYQLDIGLTIDIPIVGDITIPVSTQGEDKLPSLRDFF

SEQ ID NO: 23957 - protein, 555 aa, Populus balsamifera subsp. trichocarpa
MEYYQARTMLLVIFIFPALVECKVRLYNFRVVLTNTTKLCSSKSIPTINGKFPGPTIYAREGDNVNIRLTNQVQYNVTVHWHGVSSCFTGWADGPAYITQCPIQPGQSYLYNFTLTGQRGTLLWHAHISWLRATIHGAIVIFPKKGVPYPFPKPDKEKIIILSEWWKADVEAVVNQATMTGLPPNISDAHTVNGHTGAVPGCTSPGFTLHVESGKTYLLRIINAALNDELFFKIAGHNITVVEVDATFTKPFSTDTIFIGPGQTTNALLTADKSIGKYLIAVSPFMDTVVAVDNVTAIAFLRYNEPLHSPHLSLTTTPAINATPATSTFMDKLRSLNSKKYPANVPLTVDHDLYFTIGVGIDPCATCTNGSKAVADINNVSFIMPTTALLQAHYYNISGVFTDDFPAKPPISFNYTGNNTAMNLKTTNGTRAYRLAFNSAVQVVLQGTTIIAPESHPFHLHGFNFFVVGKGIGNFDPDNDPKKFNLADPVERNTVSVPTAGWIAIRFKADNPGVWFLHCHLEVHTTWGLKMAFVVDNGKGPNESILPPPSDLPTC

SEQ ID NO: 23958 - protein, 574 aa, Populus balsamifera subsp. trichocarpa
MEVINRIFANRHCSFFLLLLLASAMSLAIAKTHHHDFTVQATKVKRLCKTHNSITVNGMFPGPTLEVKNGDTLVVKVVNRARYNVTIHWHGIRQMRTGWADGPEFVTQCPIRPGGSYTYRFTIEGTRRNTLGWHAHSSWLRATVYGALIIHPREGSSYSFSKPKRETPILLGEWWDTNPIDVVREATRTGAAPNISDAYTINGQPGDLFNCSSKDTTIVPIDSGETNLLRVINAALNQPLFFTIANHKFTVVGADASYLKPFTTSVIMLGPGQTTDVLISGDQLPGRYYMAARAYQSAQNAPFDNTTTTAILEYKSVLCPAKCTKKPFMPPLPAYNDTATVTAFSRSFRSPRKVEVPTDIDENLFFTIGLGLNNCPKNFRARRCQGPNGTRFTASMNMVSFVFFKASLLQAYKQKIPGVFTTDFPAKPQVKFDYTGNVSRSLFQPARGTKLYKLKYGSRVQIVLQDTSIVTPENHPIHLHGYDFYIIAEGFGNFNPKTDKSKFNLVDPPMRNTVAVPVNGWAVIRFVADNPGVWLMHCHLDVHITWGLAMAFLVEEGIGILQSVEPPPADLPIC

SEQ ID NO: 23959 - protein, 580 aa, Populus balsamifera subsp. trichocarpa
MGNSPRSTVLPSMAALQLLCFFFFSLVPDFAAAITRQYTFNITHKNFTRLCHTRSLVTVNGQFPGPRLVAREGDQVLVKVVNHVAENITIHWHGVRQLTTGWADGPAYVTQCPIQTGQAYTYNFTITGQRGTLLWHAHISWLRSSLYGPIIILPKLNESYPFKKPYKEIPILFGEWFNVDPEAVIAQALQTGAGPNVSDAYTINGLPGPLYNCSAKDTYKLKVKPGKTYLLRLINAALNDELFFSIANHTLTVVEADAVYVKPFEADTLLISPGQTTNVLLKTKPHLPNATFYMFAGPYFSGMGSFDNSTTAGVLVYKHPSSNNHLKKLPTLKPTLPPINATGFVANFTKKFRSLANAKFPANVPQTVDRKFFFTVGLGTNPCPKNTTCQGTNNNTKFAASINNVSFVLPSVALLQSYFLWTVNGVFTSDFPQNPTIPFNYTGTPPNNTMVSNGTKAVVLTFNTSVELVMQGTSIVAAESHPLHLHGFNFFVVGQGFGNYDPNKDPSNFNLVDPMERNTAGVPAGGWIAIRFLADNPGVWFMHCHLDVHTSWGLRMAWIVLDGPQPNQKIPPPPSDLPKC

SEQ ID NO: 23960 - protein, 344 aa, Schizophyllum commune
MSSYKLFCMGNPLLDLQVRDGEKLLEKYGLKSNDAILAEEKHLLLYDEIVKEHEVTYVAGGAAQNAARGAAYCLPPKSVVYTGCVGDDDLAEQLKAANKREGLDEAYLVKKGEKTGACAVIITGHDRSLVTTLRAAEKFEQSHLSSEAVAPLVDAVQFYYMEGYFVTHGLASALELAGKSAAKSKCFVLNFSAPFIPQFFMPAIQQLLPYVDIVIANESEAEAWASASGHPAPTDLAAVAKSLAMQPKTNPARPRVVIFTHGAEETVVVNSAEPGRVRTFKVDKLAEGEIVDTNGAGDAFAGGFLGALVAGRELDDSVEAGHKLAKISIQQIGPQFKWPKVQIL

SEQ ID NO: 23961 - protein, 483 aa, Burkholderia sp. RP007
MDTQLIIDNADVPATAAATFERRSPTTGELVTRAAAASVADAIAAADSAAAAYRSWSTTGPTERRRILLKAADLLEARTPEFSRVMALEVGASDLWAGVNVMLAANLFREAAALTTQIQGETIPTDKAGVLSMTVRQPVGVILSIAPWNGPVVLAARAIAYPLVCGNTVVFRASELSPKTHMLIVDVLRDAGLPPGVLNAVTNAPQDAPEVVDALIAHPAVRRINFTGSTRVGRVIAEKAARHLKRCLLELGGKAPLVVLDDADIDEAVKAAVFGAFLYQGQICMSTERIVVDEKIADTFVARFAARARELPVGDPATCGGCVVGPMIVRESGDRINAMINDAVNQGANVVAGGFADGAVMPATIVDRVTPAMRIYDEETFGPITTVVRAKDADDAVRIANDTAYGLSSAVFGRDVTRALSVAMRIEAGSCHINGSTVQNEAQAPYGGTKASGYGRFDGRAVIDEFTELKWITIEPTPQSYPF

SEQ ID NO: 23962 - protein, 806 aa, Anabaena sp.
MSELMQAILDSEEKHDLRGFISELRQQDKNYLLRNDILNVYAEYCSKCQKPETSYKFSNLSKLIYYTQEIIPEDSNFCFIIRPKIAAQEVYRLTADLDVEPMTVQELLDLRDRLVNKFHPYEGDILELDFGPFYDYTPTIRDPKNIGKGVQYLNRYLSSKLFQDSQQWLESLFNFLRLHNYNGIQLLINHQIQSQQQLSQQVKNALNFVSDRPNDEPYEQFRLQLQTMGFEPGWGNTASRVRDTLNILDELIDSPDPQTLEAFISRIPMIFRIVLVSAHGWFGQEGVLGRPDTGGQVVYVLDQAKNLEKQLQEDAILAGLEVLNVQPKVIILTRLIPNSDGTLCNQRLEKVYGTENAWILRVPLREFNPKMTQNWISRFEFWPYLETFAIDSERELLAEFQGRPDLIVGNYTDGNLVAFLLTRRMKVTQCNIAHALEKSKYLFSNLYWQDLEEKYHFSLQFTADLIAMNAANFVISSTYQEIVGTPDSIGQYESYKCFTMPELYHVVNGIELFSPKFNVVPPGVNENSYFPYTQTQNRIESDRDRLEEMLFTLEDSSQIFGKLDDPNKRPIFSMARLDRIKNLTGLAECFGQSQELQERCNLILVAGKLRIEESEDNEEKDEIVKLYRIIDEYNLHGKIRWLGVRLSKNDSGEIYRVICDRQGIFVQPALFEAFGLTILESMISGLPTFATQFGGPLEIIQDKINGFYINPTHLEETATKILDFVTKCEQNPNYWNIISEKAIDRVYSTYTWKIHTTKLLTLARIYGFWNFTSKEKREDLLRYLESLFYLIYKPRAQQLLEQHKYR

SEQ ID NO: 23963 - protein, 435 aa, Penicillium simplicissimum
MLTSLSLTALALLPSANALVRKDGVGRLPALGWNSWNAFGCDVDSTKIMTAANEMVHLGLKDLGYEYVNIDDCWSVKNTRNSTTQRIIPDTQKFPDGISGVADQVHQLGLKIGIYSSAGETTCAGYPASLGYEKVDAEAFAEWGIDYLKYDNCGVPSNWTDQYSSCVPDGSNEPANGTCPGLSNPAPAGYDWTKSNTFTRYTMMRDALLGQTRTILYSLCDWGQADVNTWGNETGNSWRMSGDISANWARIAQIANENTFRMNYVGFWGHPDPDMLEVGNGDLTAAENRAHFALWAIMKSPLIIGTALDGISDANLAVLKNKYLIEFNQDPIIGRSAHPYKWGYNPDWTFDPAHPAEYWSGPSSTLKGTLVLMLNSENSTSTRTAVWKEIPELKGHNAYRVTDAWSGKDLGCVKKQYSASLASHDVAVLVVKEAC

SEQ ID NO: 23964 - protein, 333 aa, Zea mays
MSKAKVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFMNADNQHLVSPEAIDFLDKLLRYDHQDRLTAREAMAHPYFLQVRAVENSRTRPQ

SEQ ID NO: 23965 - protein, 332 aa, Zea mays
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGKIFRKEPFFYGHDNHDQLVKIAKVLGTDGLNVYLNKYRIELDPQLEALVGRHRRKPWLKFMNADNQHLVSPEAIDFLDKLLRYDHQERLTALEAKTHPYFQQVRAAENSRTRA

SEQ ID NO: 23966 - protein, 380 aa, Escherichia coli
MVDKIIFTVTPIFSIPPRGAAAVETWMYQVAQRTNFPNRIVCIKNPGYSNYTFVNDNCSIHRVGFSRIYKRLFQKWTRLDPLPYSQRILNIAHDFPITKESVIVVHNSMKLYTQIRKRAPQARVVIHMHNAFEPKLLEQNVKMIVPSLYLKKYYQSYLANADIEIVPNGIDLETYQSNFQPITRSELNISPEEKIIFYAGRIVPDKGILLLMQSFEKLAAAHKNLKLVVIGDYTEMSKSDKGAYQRNVREIAKRLKDRCIMLGSIPPEKMHCYYPLADLVVIPSQFQEPFCMVAIEAMGAGKPVLVSTRGGMTEFVKENTTGFHLKEPMTADSISSDILKTLANPELTAVAKQGQDFVFEHYSWDGVTQRFEEVIHNWFE

SEQ ID NO: 23967 - protein, 367 aa, Escherichia coli O157:H7
MKILFTESSSDIGGQELQALAQMTALQKQGHSVLLACREKSKIAPEARKRGHDVTFIPFRNSLHLPSILRLRRIIGEFKPDLVICHSGHDSNIAGLSRLICCHRFSIVRQKTYITRKTRTFSLNYLCDFIVVPSSAMMAHLMAEGVRTPVTVIPPGFDWPALHNEAMRPLPLHIHAWAASADNVPLIVQVGMLRPEKGHEFMLRVLYQLKMEGKSFRWLVVGAGREEYEARLRQQTEHLGMSGDVLMAGALFPALPVYRIASVVVMPSENEAFGMVLAEASVSGVPVIASETGGIPDVIQKNVTGTLLPVGDVSAWTGALRDFLSRPERFRMMAASAREDIEYRFDINRTAQIIVSLASQAKGKCNR

SEQ ID NO: 23968 - protein, 617 aa, Saccharomyces cerevisiae
MSKQFSHTTNDRRSSIIYSTSVGKAGLFTPADYIPQESEENLIEGEEQEGSEEEPSYTGNDDETEREGEYHSLLDANNSRTLQQEAWQQGYDSHDRKRLLDEERDLLIDNKLLSQHGNGGGDIESHGHGQAIGPDEEERPAEIANTWESAIESGQKISTTFKRETQVITMNALPLIFTFILQNSLSLASIFSVSHLGTKELGGVTLGSMTANITGLAAIQGLCTCLDTLCAQAYGAKNYHLVGVLVQRCAVITILAFLPMMYVWFVWSEKILALMIPERELCALAANYLRVTAFGVPGFILFECGKRFLQCQGIFHASTIVLFVCAPLNALMNYLLVWNDKIGIGYLGAPLSVVINYWLMTLGLLIYAMTTKHKERPLKCWNGIIPKEQAFKNWRKMINLAIPGVVMVEAEFLGFEVLTIFASHLGTDALGAQSIVATIASLAYQVPFSISVSTSTRVANFIGASLYDSCMITCRVSLLLSFVCSSMNMFVICRYKEQIASLFSTESAVVKMVVDTLPLLAFMQLFDAFNASTAGCLRGQGRQKIGGYINLVAFYCLGVPMAYVLAFLYHLGVGGLWLGITSALVMMSVCQGYAVFHGDRRRILGAARKRNAETHTS

SEQ ID NO: 23969 - protein, 264 aa, Brassica napus
MGRGKIEIKRIENANSRQVTFSKRRAGLLKKAHELSVLCDAEVAVIVFSKSGKLFEFSSTSMKKTLLRYGNYQISSDVPGINCKTENQEECTEVDLLKDEISMLQEKHLHMQGKPLNLLSLKELQHLEKQLNFSLISVRERKELLLTKQLEESRLKEQRAELENETLRRQVQELRSFLPSINQHYAPSYIRCFAIDPKNSLLSNTCLGDINCSLQNTNSDTTLQLGLPGEAHDTRKNEGDRESPSSDSVTTSTTRATAQRISLV

SEQ ID NO: 23970 - protein, 373 aa, Lycopersicon esculentum
MPSRISDSCRPHHSQKHFDLNSIKELPESHAWTSSNDHYTQENSCNFESIPVIDLDNNNNNNNNNILDHIGHACKKWGAFQIINHSISEKLLQDIEVAGKTLFSLPMQQKLKAARSPDGVTGYGAARISSFFSKLMWSEGFTIVGSPIEHARQLWPKDYNKFCEVIEEYEKEMEKLAGRLMWLILGSLGITKDDVKWAVGPKGETKEGCAALQLNSYPACPDPGRAMGLAAHTDSTILTILHQNNTSGLQVYQEGNGWITVPPIPGALVVNIGDLLHILSNGSYPSVLHRAVVNRTRYRLSVAYLYGPPSGVRVSPLSKLVDHRHPPLYRAVTWSEYLGTKAKYFDKALSSVRLCVPLNGFTDAKDHKGVQVG

SEQ ID NO: 23971 - protein, 355 aa, Lycopersicon esculentum
MPSIISSQLDLYSIKELPESHAWKSSLDDDGSRNINAESIPVIDLNHDHKFVMDTIGHACKTWGAFQIVNHNISHRLLNHMETHGTRLFSLPMQQKLKAARSSDGIAGYGVARISSFFDKLMWSEGFTIFGSPLEHARQLWPYDYNKFCDVIEEYENEMEKLAGRLMGLMLGSLGIAKEDVKWAVGPRSGSSALQLNSYPACPDPDRAMGLAAHTDSTLLTILHQNNTSGLQVFKEGNGWVTVPLLRGALVINVGDLLHILSNGLYPSVLHRAIVNRTRHRLSVAYLYGPPSGVKISPLSKLVDQRNPQMYRPVTWSEYLGTKAKHFDKALSSVRLCAPRIGFANSKDQSGVQVG

SEQ ID NO: 23972 - protein, 1115 aa, Saccharomyces cerevisiae
MRLLRRNMLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTSENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGFMPEKEIPIVESKSLNCPSSSENVTKPFDMKSGKQVVFEGAVNDGSLKSEKDKHDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 23973 - protein, 498 aa, Cicer arietinum
MGILSLLCYSLFYLSFFFIIRLLFQSRKFKNLPPGPPSLPIIGNLHHLKRPLHRTFKGLSKTYGDIISLWFGSRLVVVVSSLSEFQQCFTKNDVVLANRPRFLSGKYIFYNYTTLGSTSYSEHWRNLRRITSLDVLSNHRINNFSGVRRDETQRLITKLAEDSSTSFAEVELSFRFYDMTFNNIMRMIPGKRYYGEDCDMSDLQEASQFRDMVTELLQLSGANNKTDFMPLLKFFDFENLEKRVKNIADKTDAFLRGLLQEQRNKKERTNTMIDHLLNLQESQPEYYTDQIIKGLALAMLLAGTDSSAVTLEWSMSNLLNHPEILKKVKDELDIHVGQDRLVDESDLPKLTYLKNVIYETLRLCTPAPLLLPHSTSDDCIIGGYKVPRDTIVLINAWAIHRDPKSWSEATSFKPERFDKKGEIEKVIAFGMGRRVCPGEALALRTISMTLALLVQCFDWKRTSDDKIDMAERDGFVLTKLIPLKAMCKTRPVVNKVFK

SEQ ID NO: 23974 - protein, 151 aa, Pseudotsuga menziesii
MASLMDKAKQFVVDKIAHIEKPSADVTDIDMKNLTTDSVTLESAIDITNPYDHDLPIWEISFRLRSADKLIASGTIKDPGSVKANDKTGMIVPVTVPYNFLISIMKDLGRDWDIDYEWDIGLTMHIPVVGKFTLPLNKKGTMKLPTLSDIF

SEQ ID NO: 23975 - protein, 373 aa, Zea mays; identical to SEQ ID NO: 6863

SEQ ID NO: 23976 - protein, 374 aa, Zea mays; identical to SEQ ID NO: 5600

SEQ ID NO: 23977 - protein, 374 aa, Zea mays; identical to SEQ ID NO: 5700

SEQ ID NO: 23978 - protein, 846 aa, Magnaporthe grisea
MTVVAGPTYPLELLQGTKVTKFAKKRGSTTSRKQLMLVLDAQSAKITWDKSKPSKSIYIDDIKDIRTAEDIRQYRLDFGIPESEEPLCFSIIYATHDVKPKTKMMHLVAGDPAIVDMWVSTLHTISMHRQDIMSSLMAFNDKAIRTYWKNELHKQLKNTSNNGEENIDFLGVERVCQNLHIHVSSETLKEKFLEALGTSSVDADASVKNGRLNFSQFQEFVRLMKRRADIRPIFRERASDIERGMTLLDFVSFLTDVQNEDVDADRAYWEAIFARFAKRNKSKDLEGDDVPRISEAALVSFLTSTYNVPIVSAPKNYTLDRPINEYYISSSHNTYLLGRQVMGFSSVEGYISALMRGCRSVEVDCWDGGDGWPLVSHGWTMTTNIAFREVMNVINKYAFVKSEFPLWISLEVHCNPDQQRKMVAIMKEIFGARLVTEPLEGLPADKLPSPSQFKNRILIKAKKPGHEEPNPERTGRRRGNSLTSPYTKPVMLDNSTIPSQSLPHSPLLTPTHSQIRRMGAKTRVYTITEGRVHDSTSGSPSDCDSGSERDIQQPISPNSGTSKIVKELGDLAVYCAGIKFSGFEHPDSKTVNHIFSFHEGTFQRHGRPGDAKRALYRHNMRYMMRVYPHRGRVYSSNFDPLLMWRRGVQMAALNWQTFDLGMQLNHAMYDGGMDQSGYVLKPKEFREIQHFPYLPEHMVGGKRPRKNVKFSIDVISAQQLMRPHNLRDRHTLDPYIEVEAFLADDKRNTNKEYSDAGPSKTKHKTPIAKDNGFNPIFDQRYNFNFNTKYPDLIFIRWTVRLSEGGSQSDRSTILGTESVNKLRSLGRTVFNRSNNSPKSSVDGGSQ

SEQ ID NO: 23979 - protein, 753 aa, Acanthamoeba castellanii
MENNDVKSGLASILAGDLKTDELYRQMGLQAGGPPKGGSMIVPPSSSPTNGVKTGEKDKKKLDSAKNKKKKGFWGQVGGFFGVKEEEEDATPISGPTNFKREMHIGFDSQTGTFEGLPEEWKIMLGTSGLSQKEIESDPKTLVEVMQFQQNLLRGGAPPPPPPPGGSAAFVDDEPPPPPPPRDDGEFEAPPPPPVPREQEPEPQQAPLSPPPRPISLPPGARPPVQVAPGADLPVPPRPNQPPPMRGRGGPMRRGAPPGRPSPGRTLPPPPGGAPAGPGPTTGRGLPPRPGAPNGAPMPLQRGGASGDAPLPLTRGPPGGGAPRGPGAPPPRPGQPAPMRPGQPGGQGVPPPRPGQPAPGRPTMRPSQPGGPPRPPMPAPVPTTPTAAVTPAPVPVPAPAPAPAPADTTPAAGPPRPTPPIATGARPAPPRPQPPKAGGAPPPAAAPQPARPQVNIRDLISQGDPLTIFKDMEIIGQGASGSVYSAIDTRTGKKVAVKQMIMSKQVKQDIIINEIQIMKDSHHHAIVNYIDSYIVEGTLWVVMELINGGSLAELIEVCKTMNETQIATVCKVVLEGLEYLHTRANPIIHRDIKSDNILLGLDGSIKITDFGYGAQLGVGAGQDKRASVVGTTYWMAPEVVKGKDYTCKVDVWSLGIMALEMLEGEPPYINESMLRALFLIASKGCPDFKDPDGMSEEFKDFIRKCTVMDPEQRMSTTQLLSHPFLTMGGPESDLIPLVERTKNEAQRDFSMFF

SEQ ID NO: 23980 - protein, 318 aa, Trypanosoma congolense
MAVVVEGQLKGHRGWVTSLACPQAAESSTKVVSASRDKTLLSWAANPVRHSSECDYGLPERRLEGHSAFVSDVALSNNGDFAVSSSWDHSLRLWNLQSGQCQHKFLGHTKDVLSVAFSPDNRQIVSGGRDNALRVWNVKGECMHTWTRGAHTDWVSCVRFSPSLEAPIIVSGGWDNLVKVWDLATGRLVTDLKGHTNYVTSVTVSPDGSLCASSDKDGVARLWDLTKGESLSEMAAGAPINQICFSPNRYWMCAATEKVIRIFDLESKDVIVELAPETQSNCKTLPECVSIAWSADGSTLYSGYTDNVIRVWSVSDRA

SEQ ID NO: 23981 - protein, 317 aa, Trypanosoma vivax
MAVVYEGHSRGHRGWVTSLVCPQCEQTGINVVSASRDKTLISWSDNPNRHAEENDYCIPERRLEGHSAFVSDVALSNNGSFAVSASWDRSMRLWNLQNGQCQYKFLGHTRDVLSVAFSPDNRQIVSGSRDRTLRVWNVKGECMHTLNGAHSDWVSCVRFSPATDKPLIVSGGWDNLVKVWDPAGGVSRVVSELKGHTNYVTSVTVSPDGSLCASSDCDGVARLWDLAKGDSLFEMSAGAPINQICFSPNRYWMCAATDECIRIFDLENKDVIVELTPEAHGSKPPQCQSIAWSADGSTLYSGHADNVIRIWTVSLKA

SEQ ID NO: 23982 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQEVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 23983 - protein, 263 aa, Holcus lanatus
MASSSLVLLVVALFAVFLGTAHGIAKVPPGPNITATYGDKWLDAKSTWYGKPTGAGPKDNGGACGYKDVDKPPFSGMTGCGNTPIFKSGRGCGSCFEIKCTKPESCSGEPIVVHITDDNEEPIAAYHLDLSGKAFGAMAKKGEEQKLRSAGELELKFRRVKCEYPKGTKVTFHVEKGSNPNYLALLVKYVDGDGDVVAVDIKEKGKDKWIELKESWGAVWRVDTPDKLTGPFTVRYTTEGGTKVEAEDVIPEGWKADTAYESK

SEQ ID NO: 23984 - protein, 379 aa, Homo sapiens
MGCLGNSKTEDQRNEEKAQREANKKIEKQLQKDKQVYRATHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 23985 - protein, 349 aa, Homo sapiens
SAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 23986 - protein, 354 aa, Homo sapiens [sequence omitted]

SEQ ID NO: 23987 - protein, 846 aa, Brassica oleracea
TSFLLVFVVMILFHPAFSIYINTLSSAESLTISSNRTLVSPGNIFELGFFRTPSSSRWYLGMWYKKVSDRTYVWVANRDNPLSNSIGTLKISNMNLVLIDHSNKSVWSTNHTRGNERSPVVAELLANGNFVMRDSNNNDASGFLWQSFDYPTDTLLPEMKLGYDLRTGLNRFLTSWRNSDDPSSGDFSYKLDTQRGLPEFYLWKESNFLVHRSGPWNGVGFSGMPEDQKLSYMVYNFTQNSEEVAYTFLMTNNSIYSRLTISSSGYFERLTWNPSSETWNVFWSSPEDLRCDVYKICGAYSYCDVNTSPVCNCIQGFDPWNVQEWDLRAWSGGCIRRTRLSCSGDGFTRMKNMKLPETTMAIVDRSISLKECKKRCLSDCNCTAFANTDIRNGGSGCVIWTELLEDIRTYFTNGQDLYVRLAAADLVKKRNANGKIISLIVGVSGLLLLIMFCIWKTKQKRVKGSAISIANRERSQNLPMTGMVLSSKTQLSGVNQIEELELPLIELEVVIKATENFSNCNKLGQGGFGIVYKGTLIDGQEIAVKRLSKTSIQGTDEFMNEVTLIARLQHINLVQIHGCCIEADEKMLIYEYLENLSLDSYIFGNPRSTKLNWKERFDIINGVARGLLYLHQDSRFRIIHRDLKVSNILLDKNMIPKISDFGMARIFARDETEANTMKVVGTYGYMSPEYAMGGIFSEKSDVFSFGVIVLEIVTGKRNRGFYNLSYEYSLLSYAWSNWKEGRALEIVDSVLVDSLSPLSSTFQPQEVLKCIQIGLLCVQELAEHRPTMSSVVWMLGSEATEIPHPKPPGNCVGRSPYELDPSSSRQYEDDESWTVNQYTCSVIDAR

SEQ ID NO: 23988 - protein, 860 aa, Brassica rapa
MKGVRNIYHHSYTSFLLVFVVMILFRPTLSIYFNTLSSTESLTISNSRTLVSPGDVFELGFFKTTSSSRWYLGIWYKKLPGRTYVWVANRDNPLSNSIGTLKISNMNLVILDHSNKSVWSTNHTRGNERSLVVAELLANGNFLMRDSNSNDAYGFLWQSFDYPTDTLLPEMKLGYDLKIGLNRSLTSWRSPDDPSSGYFSYKLEGSRRLPEFYLMQGDVREHRSGPWNGIQFIGIPEDQKSSYMMYNFTDNSEEVAYTFVMTNNGIYSRLKLSSDGYLERLTWAPSSGAWNVFWSSPNHQCDMYRMCGTYSYCDVNTSPSCNCIPGFNPKNRQQWDLRIPISGCKRRTRLSCNGDGFTRMKNMKLPDTTMAIVDRSMGVKECEKRCLSDCNCTAFANADIRNGGTGCVIWTGELEDMRNYAEGGQELYVRLAAADLVKKRNGNWKIISLIVGVSVVLLLLLLLLIMFCLWKRKQNRAKAMATSIVNQQRNQNVLMNTMTQSNKRQLSRENKADEFELPLIELEAVVKATENFSNCNELGRGGFGIVYKGMLDGQEVAVKRLSKTSLQGIDEFMNEVRLIARLQHINLVRILGCCIEAGEKILIYEYLENSSLDYFLFGKKRSSNLNWKDRFAITNGVARGLLYLHQDSRFRIIHRDLKPGNILLDKYMIPKISDFGMARIFARDETQVRTDNAVGTYGYMSPEYAMYGVISEKTDVFSFGVIVLEIVIGKRNRGFYQVNPENNLPSYAWTHWAEGRALEIVDPVILDSLSSLPSTFKPKEVLKCIQIGLLCIQERAEHRPTMSSVVWMLGSEATEIPQPKPPVYCLIASYYANNPSSSRQFDDDESWTVNKYTCSVIDAR

SEQ ID NO: 23989 - protein, 242 aa, Ceratopteris richardii
  unsure (1)..(242): unsure at all Xaa locations
MLNYSFDXVKXISSSDLIXPAGNYYQHVTFNEQGDLADDDGICYDIINSTGEKKRGLTVDQVKYLEMNFTMDFKLEPERKALIAKELGLRPRQVAIWFQNRRARWKNKQLEQDYETLKSSYEALLQENEDMVKRNKALDEENKLLQAEIARLTGISGNVDVPVDIDAKVASPDLDSDSDLESTVKGEKQQNLKSEIGIPAKLDAQSEILESLTLSCLKSQEAIVAFVEQPIGANDSVVACAL

SEQ ID NO: 23990 - protein, 256 aa, Ceratopteris richardii
MPFIPATMKHHAALDSTDIKGKSKNSCKDLKSRALKRSRQDVVVDSDTEEKRRGLTMEQINILEMKFKEDVELEPERKTLIAKQLGLRPRQVAIWFQNRRARWKNKQVECKYELLKAQYDAVVKEKESITMEHESILEGNRRLHSESIEKANTLGGAISPALPSCNIMSPTDSADCQSEIIMSVDVIEGAISCCHPIQEPSSRMAADVVVETEYSFYSSLDNSFSQFPMLVRQLIANGHCLQDAYDIYLGCEYFYG

SEQ ID NO: 23991 - protein, 192 aa, Ceratopteris richardii
MAWSVSVGSTSIPQDEDETKQSVITSGISKTKGHNQGHRKHPSKDVTKDIGDGDELMCGVEKKRRLTAEQVNFLETSFSMDLKLEPERKAHLAKQLGIQPRQVAIWFQNRRARWKNQQIEQDYESLKASYEAVVEEKERLLKEHDLALEANKRLQAEIARLTRSLQSYDRNGMSEPKGGTAEQWQIRGNVNQ

SEQ ID NO: 23992 - protein, 274 aa, Ceratopteris richardii
MAWSPVKEEHLPQLVSTESTIEKTLKAKDPCKRPKRRAKKRTGKGSTIDDSIDKRRGLTVEQINFLEMSFKEDNKLEPERKACIAKQLGVRPRQVAIWFQNRRVRWKNKQVEQDYETLKARYQDVVKEKDSIMMQYESTMEGNRKLQAEVARLTNLLQSTEGISAHTDMDQVLSNCNSENLNCISENISPAKSADYPSEIIVSGDPTEGDISRFIFQEPISSMPYDLLPDGDYFILSPENSTGSFPSLVQQLVSNGHCVEDAYNIYLGYEYLCC

SEQ ID NO: 23993 - protein, 227 aa, Ceratopteris richardii
RRSPPKEELDDDDLGDELSNPTEKNRRLTAEQVNFLEMSFNIDLKLEPERKALLAKKLGIRPRQVAIWFQNRRARWKNKQIEQDYESLKTKYEAVIKEREVILLQHEAAMQENKRLQAEVRRLMDLVEATGVGACDVTGVSEGKSELMSPSKSTGRSRVTCKTRVKCHSIAVSASGADVPMPRFELDYGFCRSNDMGVDLHECPTFSLWRIFLGLICPCLFVKFASK

SEQ ID NO: 23994 - protein, 194 aa, Ceratopteris richardii
NQGHRKHPSKDVTKDIGDGDELMCGVEKKRRLTAEQVNFLETSFSMDLKLEPERKAHLAKQLGIQPRQVAIWFQNRRARWKNQQIEQDYESLKASYEAVVEEKERLLKEHDLALEANKRLQAEVCFKHAMSLLWSGYEESHVNIYSMTDSITNAYFHCLTRRHSSLILLHFSSQHTLIGFGGICDAWSPTFRYI

SEQ ID NO: 23995 - protein, 455 aa, Rhizomucor pusillus
MTSKSLNVAFIHPDLGIGGAERLVVDAAVGIQKKGHQVIFYTSHHDPNHCFEETRDGTLKVQVRGDWLPRTIFGRFYILCAILRQFVLVASLILWERHSYDIFFVDQLSACVPLLKWFTTAKILFYCHFPDKLLTQRNSTIKKLYRAPVDKMEELTTGMSDLIAVNSGFTAGMFKKSFPSVHQTPQILYPPINFDAYDRPVDRNDPTVKILETDKRVLLSINRFERKKNVELALRAFAALKIKNMVPKDVFANYRLVLAGGYDKRVRENVEYLEELDQLATEEFGLQTFTIHPSSAAADVPADAQVVFLCSFNDAQRTFLLDQAKLLLYTPSNEHFGITPVEGMYASVPVIAVNTGGPVETVKNKETGLLLPSDPDVWAEGIRDFIIEKYNGKQMGQHGRQHVQSKFSLPAFADRLEAMMIELETSTPDQSSSGAVYLLGAIGVLFACIIYCIKQ

SEQ ID NO: 23996 - protein, 367 aa, Streptomyces coelicolor A3(2)
MRSYVRQEQPPGGRTGLRLCGGHVAPSAHGRGTQATSAPHATTRRSAPDHPALREPPCHLPLSDHLRVGSGGTLNGRGRVRTMAQEVRGVIAPGKDEPVRIETIVVPDPGPGEAVVKIQACGVCHTDLHYKQGGINDEFPFLLGHEAAGVVESVGAGVTDVAPGDFVILNWRAVCGKCRACRRGRPWYCFDTHNAEQRMTLASTGQELSPALGIGAFAEKTLVAAGQCTKVDPAVPAEVAGLLGCGVMAGIGAAINTGNVGRGDTVAVIGCGGVGDAAIAGSYLAGASKVIAVDIDDRKLETARTMGATHTVNSRGTDPVEAIRELTGGFGADVVIEPSAARRPTARPSTPATWPAPSSWSACPLPR

SEQ ID NO: 23997 - protein, 335 aa, Homo sapiens
WTAPAAVQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 23998 - protein, 284 aa, Mus musculus
WLLLERAKELNIDVIGVSFHVGSGCTDPETFVQAVSDARCVFDMATEVGFSMHLLDIGGGFPGSEDTKLKFEEITSVINPALDKYFPSDSGVRIIAEPGRYYVASAFTLAVNIIAKKTVWKEQPGSDDEDESNEQTFMYYVNDGVYGSFNCILYDHAHVKALLQKRPKPDEKYYSSSIWGPTCDGLDRIVERCNLPEMHVGDWMLFENMGAYTVAAASTFNGFQRPNIYYVMSRPMWQLMKQIQSHGFPPEVEEQDDGTLPMSCAQESGMDRHPAACASARINV

SEQ ID NO: 23999 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVVVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 24000 - protein, 742 aa, Homo sapiens
FKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLQTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 24001 - protein, 309 aa, Dictyostelium discoideum
MSNQKKNDVSSFVKDSLIGGTAGGVSKTIVAPIERVKLLLQVQSASTQIAADKQYKGIVDCFVRVSKEQGVISLWRGNLANVIRYFPTQALNFAFKDKYKKFFVRHTAKENPTKFFIGNLLSGGAAGATSLLFVYPLDFARTRLAADVGTGSARQFTGLGNCISSIYKRDGLIGLYRGFGVSVGGIFVYRAAFFGGYDTAKGILLGENNKKASFWASWGIAQVVTTIAGVVSYPFDTVRRRMMMQAGRADILYSSTWDCWVKIATREGPTAFFKGALSNAIRGSGGALVLVIYDEIQKLMGFEGGVGSE

SEQ ID NO: 24002 - protein, 157 aa, Oryza sativa; identical to SEQ ID NO: 3451

SEQ ID NO: 24003 - protein, 197 aa, Ricinus communis
HEATAKLGLLTPLHSNNIKKEFPVFDFSLFCPELRHSRFSHFNTAVKRVRYAPVVPVINAQSSPDYIPDAKFYKVEAILRPWRVSQVSSALLKIGIRGVTVSDVRGFGAQGGSTERQGGSEFSEDKFVAKVKMEIVVSKDQVEDVIEKIIEEARTGEIGDGKIFLLPVSDVIRVRTGERGDKAERMTGGRSDMSTSA

SEQ ID NO: 24004 - protein, 623 aa, Homo sapiens [sequence omitted]

SEQ ID NO: 24005 - protein, 459 aa, Pneumocystis carinii
MNAARRVTRQTATFNLNDENKLHGQISRVKQVSTQGLEGVNKPWTAATRKRAALGDVSNVHNKENQTAKTKTQPLSTKARVVTKTGVQSHQSKESVHTVPTGELRGEETTRKRRTSKVLTEQKVIIEVEQTQASKKVRTDGLLNGSVQEHPASQDWDDLDADDAHDPLMVSEYVEEIMGYMRELEVLTLPLPDYMDRQKELQWKMRGILVDWLIEVHAKFRLLPETLFLSVNIIDRFLSLRVCSLPKLQLVGITALFIAAKYEEVMCPSIQNFMYMADGGYTNEEILKAEQYVLQVLGYDMSYPNPINFLRRVSKADNYDIQTRTVAKYLMEISLLDHRFLPFVPSNIAASGIYLARIMVTGGNWNANLIHYSGYKESDLVPCSKMMLDYLSRSVIKHEAFFKKYASKKFMKASLFVRDWVKKHYDLEANVRLNTISFDYDNHESNEIHQDLEEEEGSL

SEQ ID NO: 24006 - protein, 255 aa, Nicotiana tabacum
MAREENVYMAKLAEQAERYEEMVSFMEKVSTSLGTSEELTVEERNLLSVAYKNVIGARRASWRIISSIEQKEESRGNEDHVKCIQEYRSKIESELSNICDGILKLLDSCLIPSASAGDSKVFYLKMKGDYHRYLAEFKTGAERKEAAESTLSAYKAAQDIANAELAPTHPIRLGLALNFSVFYYEILNSPDRACNLAKQAFDEAIAELDTLGEESYKDSTLIMQLLRDNLTLWTSDMQDDGADEIKETKTDNEQQ

SEQ ID NO: 24007 - protein, 249 aa, Nicotiana tabacum
MAVPENLTREQCLYLAKLAEQAERYEEMVKFMDRLVAVSASSELTVEERNLLSVAYKNVIGSLRAAWRIVSSIEQKEEGRKNEEHVVLVKDYRSKVESELSDVCAGILKILDQYLIPSAAAGESKVFYLKMKGDYYRYLAEFKVGNERKEAAEDTMLAYKAAQDIALAELAPTHPIRLGLALNYSVFYYEILNASEKACSMAKQAFEEAIAELDTLGEESYKDSTLIMQLLRDNLTLWTSDMQEQMDEA

SEQ ID NO: 24008 - protein, 272 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDTTVSLSLSQKYTPTNADAPTNNTVHTSKSFLGSA

SEQ ID NO: 24009 - protein, 258 aa, Nicotiana tabacum
MSSSRDEFVYMAKLAEQAERYEEMVDFMEKVVTAADGGEELTIEERNLLSVAYKNVIGARRASWRIISSIEQKEESRGNEDHVTSIKTYRSKIESELTSICNGILKLLDSNLIRAASTGDSKVFYLKMKGDYHRYLAEFKTGAERKEAAENTLSSYKSAQDIANAELAPTHPIRLGLALNFSVFYYEILNSPDRACNLAKQAFDEAIAELDTLGEESYKDSTLIMQLLRDNLTLWTSDMQDEGTEEMKEVAKPDNEEH

SEQ ID NO: 24010 - protein, 379 aa, Oryctolagus cuniculus
MGTKGKVIKCKAAIAWEAGKPLSIEEVEVAPPKAHEVRVQINAAGLCRSDTHVINPKFEGAFLPVILGHEGAGIVESVGPGVTNVKPGDKVIPLYIPHCKKCKFCLSPLTNFCEKFCKGKNPLIEQELMEDKTSRFTCKGKSIYHFFGISAFSQYTVVKDVNLAKIDDDANLERVCLIGCGFSTGYGAAINTAKVTPGSTCAVFGLGGVGLSAIMGCKTAGASRIIAIDINSDKFAKAKALGATDCLNPRELNKPVQDVIVEMTNGGVDFAIDCAGGSEVMKATVDCATVGWGSCTFVGVNLADKGLTISPIELILGRTLKGTNFGGWDAETVPKLVSDYKNGKFDLDALVTHTLPFDKINEALNLLDQGKSIRTVLIF

SEQ ID NO: 24011 - protein, 379 aa, Oryctolagus cuniculus
MSTKGKVIKCKAAIAWEAGKPLSIEEVEVAPPKAHEVRVQIIAASVCRSDTYVINPAFKEGLLPVILGHECAGIVESVGPGVNNFKPGDKVIPLYVPHCRKCKFCQSPLTNFCTKFSEHKNPIIEQELMDDKTSRFTCKGKSIYHFLGISAFSQYTVVKDINLAKIDDDANLKRVCLIGCGFSTGYGAAINDAKVTPGSTCAVFGLGGVGLSAVIGCKTAGASRIIAVDINSDKFAKAKALGATDCLNPRELNKPVQDVIVEMTNGGVDFAIDCAGGSEVMKATVDCTTVGWGSCTFVGVNVNDKGLTISPVELILGRTLRGSSFGGWDVDTVPKLVSDYKNGKFNLEALVTHTLPFEKINEALDLLKQGKSIRTILIY

SEQ ID NO: 24012 - protein, 254 aa, Sinapis alba
MGRGRVELKRIENKINRQVTFAKRRNGLLKKAYELSVLCDAEVALIIFSNRGKLYEFCSSSSMIRTLERYQKCNYGPPEPNVPSREALAVELSSQQEYLKLKERYDALQRTQRNLLGEDLGPLSTKELELLERQLDSSLKQIRALRTQFMLDQLNDLQSKERMLNETNKTLRLRLADGYQMPLQLNPNQEDHHVDYGRHDQQQQQNSHHAFFQPLECEPILQMGYQGQQDHGMEAGPSENNYMLGWLPYDTNSI

SEQ ID NO: 24013 - protein, 250 aa, Solanum commersonii
  unsure (1)..(250): unsure at all Xaa locations
MGRGRVQLKRIENKINRQVTFSKRRSGLLKKAHEISVLCDAEVGLIVFSTKGKLFEYATDSCMERLLERYERYSFAEKQLVPTDHTSPGSWTLENAKLKARLEVLQRNEKLYVGEDLESLNMKELQNLEHQLASALKHIRSRKNQLMHESISVLQKQDRALQEQNNQLSKKVKEREKEVEQQNQWDQQNHEINSSTFVLPQQLDSPHLGEASQNTNVVDNGEVEGGNSSQXQGAANNTVMPQWMVRHLNG

SEQ ID NO: 24014 - protein, 378 aa, Octopus vulgaris
TDATGKPIKCMAAIAWEAKKPLSIEEVEVAPPKSGEVRIKILHSGVCHTDAYTLEGIDPEGIFPVILGHEGAGIVESIGEGVTSVKPGDTVIPLYVPQCYECKFCLNPKTNLCQKIRVTQGKGVMPDGTTRFTCKGKEVFHFMGCSTFSEFTVVAEISIAKVNPKAALDKVCLLGCGISTGYGAALNTAAVEKGSNCAVWGLGAVGLAVAMGCKAAGAARIIGIDINESKFEIGKKFGITEFVNPKKFCKSVQKVLGEMTDVGVDFTFECIGNVGVMRAALESCHKGWGTSVIVGVAAHGEEISTRPFQLVTGRVWKGTAFGGFKSRDSVPKLVDDYMNKKLLLDEFVSHKLSFKKINEAFDLMHKGESIRAVLDIPE

SEQ ID NO: 24015 - protein, 250 aa, x Aranda deborah
MGRGRVELKMIENKINRQVTFAKRRKRLLKKAYELSVLCDAEVALIIFSNRGKLYEFCSSTSMLKTLEKYQKCNFGSPESTIISRETQSSQQEYLKLKNRVEALQRSQRNLLGEDLGPLGSKELEQLERQLDSSLRQIRSTRTQFMLDQLADLQRREQMLCEANKTLKRRFEESSQANQQQVWDPSNTHAVGYGRQPAQHHGEAFYHPLECEPTLQIGYHSDITMATATASTVNNYMPPGWLGQISGSYE

SEQ ID NO: 24016 - protein, 227 aa, Lycopersicon esculentum
MGRGRVQLKRIENKINRQVTFSKRRSGLLKKAHEISVLCDAEVGLIVFSTKGKLFEYANDSCMERILERYERYSFAEKQLVPTDHTSPVSWTLEHRKLKARLEVLQRNQKHYVGEDLESLSMKELQNLEHQLDSALKHIRSRKNQLMHESISVLQKKDRALQEQNNQLSKKVKEREKSAQQISGINSSSLFAHTDFYLGTYQSTNVIDNGKWKEVVLHSSKVQLIIL

SEQ ID NO: 24017 - protein, 241 aa, Sinapis alba
MGRGRVQLKRIENKINRQVTFSKRRSGLLKKAHEISVLCDAEVALVIFSSKGKLFEYSTDSCMEKILERYDRYLYSDKQLVGRDISQSENWVLEHAKLKARVEVLEKNKRNFMGEDLDSLSLKELQSLEHQLHAAIKSIRSRKNQAMFESISALQKKDKVLQDHNNALLKKIKEREKNTVHQEVQLIQCSNNSSILQPQYCLTSSRDGFVGRVEGENEGASSLAEPNSLLPAWMLRPTTNE

SEQ ID NO: 24018 - protein, 250 aa, Solanum tuberosum
MGRGRVQLKRIENKINRQVTFSKRRSGLLKKAHEISVLCDAEVGLIVFSTKGKLFEYANDSCMERLLERYERYSFAERQLVPTDHTSPGSWTLEHAKLKARLEVLQRNQKHYVGEDLESLNMKELQNLEHQLDSALKHIRSRKNQLMHESISVLQKQDRALQEQNNQLSKKVKEREKEVAQQNQWDQQNHEINSSTFVLPQQLDSPHLGEAYQNTNVVDNGEVEGGNSSQQQGAANNTVMPQWMLRHLNG

SEQ ID NO: 24019 - protein, 224 aa, Lycopersicon esculentum
MGRGRVELKRIEGKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQCSQMHKLWAMAGKQLKLRAMASFILWIVNLLCKLGIRMIQLQ

SEQ ID NO: 24020 - protein, 242 aa, Panax ginseng
MSFYDDQSGNLSPQRKLGRGKIEIKRIENTTNRQVTFCKRRNGLLKKAYELSVLCDAEVALIVFSTRGRLYEYANNSVKGTIERYKKACTDSPNTSSVSEANAQFYQQEASKLRQEISSIQKNNRNMMGESLGSLTVRDLKGLETKLEKGISRIRSKKNELLFAEIEYMQKKEIDLHNNNQYLRAKIAENERAQQHMNLMPGSSDYELAPPQSFDGRNYIQLNGLQPNNHYSRQDQTALQLV

SEQ ID NO: 24021 - protein, 254 aa, Sinapis alba
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSSKELQNLEQQLDTALKHIRSRKNQLMHDSINELQRKEKAIQEQNSMLSKQIKEREKILRAQQEQWDQQNHGHNMPPPPPPQQIQHPYMLSHQPSPFLNMGGLYQEEDPMEMRRNDLDLSLEPVYNCNLGCFAA

SEQ ID NO: 24022 - protein, 594 aa, Oryza sativa
NYPIHMKNLSLKELQQLADELRSDVIFHVSKTGGHLGSSLGVVELTVALHYVFNTPQDKILWDVGHQSYPHKILTGRRDKMPTMRQTNGLSGFTKRSESEYDSFGTGHSSTTISAALGMAVGRDLKGGKNNVVAVIGDGAMTAGQAYEAMNNAGYLDSDMIVILNDNKQVSLPTATLDGPAPPVGALSSALSKLQSSRPLRELREVAKGVTKQIGGSVHELAAKVDEYARGMISGSGSTLFEELGLYYIGPVDGHNIDDLITILREVKSTKTTGPVLIHVVTEKGRGYPYAERAADKYHGVAKFDPATGKQFKSPAKTLSYTNYFAEALIAEAEQDNRVVAIHAAMGGGTGLNYFLRRFPNRCFDVGIAEQHAVTFAAGLACEGLKPFCAIYSSFLQRGYDQVVHDVDLQKLPVRFAMDRAGLVGADGPTHCGAFDVTYMACLPNMVVMAPSDEAELCHMVATAAAIDDRPSCFRYPRGNGIGVPLPPNYKGVPLEVGKGRVLLEGERVALLGYGSAVQYCLAAASLVERHGLKVTVADARFCKPLDQTLIRRLASSHEVLLTVEEGSIGGFGSHVAQFMALDGLLDGKLKWRP

SEQ ID NO: 24023 - protein, 528 aa, Gallus gallus
MGPEEVMVQASSPGLISATEVLVAAATFCLLLLLTQTRRQHAPKGLRSPPGPRGLPMLGSVLELRKDPHLVLTRLSRKYGDVMEVTIGSRPVVVLSGLETIKQALVRQAEDFMGRPDLYSFRHITDGQSLTFSTDTGEMWKARRKLAQNALKNFSIAASPTASSSCLLEEHVSTEASYLVTKFLQLMEEKQSFDPYRYMVVSVANVICAICFGKRYDHDDQELLSVVNVVDEFVDVTAAGNPADFIPLLRYLPSRNMDSFLDFNKRFMKLLQTAVEEHYQTFDKNNIRDVTDSLIEQCVEKKAEANGATQIPNEKIINLVNDIFGAGFDTVTTALSWSLMYLVTYPHMQKKIQAELDQTIGRERRPRLSDRGMLPYTEAFILEMFRHSSFMPFTIPHSTTRDTVLNGYYIPKDRCVFINQWQVNHDEKLWKDPQAFNPERFLNAEGTEVNKVDAEKVMTFGLGKRRCIGENIGKWEVFLFLSTLLQQLEFSIQDGKKADMTPIYGLSMKHKRCEHFQVKKRFSMKSSN

SEQ ID NO: 24024 - protein, 508 aa, Equus caballus
MWELLAFLLLAIAYFFRPKVKCPGAKYPKSLPYLPLVGSLPFLPRHGHPHVNFFKLQKKYGPIYSLRMGTKTTVMVGHYQLAKEVLIKKGKEFSGRPQVATLNILSDNQKGVAFADHGAPWQLHRKLVRAAFALFKDGNQKLEKIICHETSLLCDLLATQNGQTIDLSSPLFLAVTNVICWICFNSSYMKGDPALETMQNYHKGILETLEKDNVVDIFPALKIFPNKSLEKMRHCVNIRNELLSKIFEKHKENFNSDSITSMLDLLIQAKKNSDNNNTGPDQDSKLLSDKHILATIGDIFGAGVETTTSVVKWIVAFLLHDPQLKKKIQEEIDQNVGFSRTPTLSDRNRLLLLEATIREVLRIRPVAPMLIPHKALVDSSIGEFAVDDGTNVIINLWALHHNEKEWHQPDRFMPERFLDPTGSQLISPSLSYLPFGAGPRSCIGELLARQELFLFTAWLLQRFNLEVPDDGQLPSLEGHPTAVFLIDSFKVKINVRQAWREAQAEGST

SEQ ID NO: 24025 - protein, 901 aa, Zea mays; identical to SEQ ID NO: 6757

SEQ ID NO: 24026 - protein, 255 aa, Mycobacterium avium
MTDTATENTTESAADYGRPAFVSRSVLVTGGNRGIGLAIAQRLAAEAHKVAVTHRGSGAPDGLFGVECDVTDNDAVDRAFTEVEEHQGPVEVLVSNAGISKDAFLIRMTEERFTEVINANLTGAFRVTQRAARSMQKKRFGRIIYIGSVSGMWGIGNQANYAAAKAGLIGMARSISRELSKAGVTANVVAPGYIDTEMTRALDERIQAGALEFIPAKRVGTAAEVPGAVSFLASEDASYIAGAVIPVDGGMGMGH

SEQ ID NO: 24027 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGQETSAPFNTRGLFRS

SEQ ID NO: 24028 - protein, 339 aa, Oryza sativa; identical to SEQ ID NO: 3630

SEQ ID NO: 24029 - protein, 406 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 24030 - protein, 384 aa, Pisum sativum
MGLLCSKSNRYNDAKAEENAQTAEIERRIELETKAEKHIRKLLLLGAGESGKSTIFKQIKLLFQTGFDEAELKSYLPVVHANVYQTIKLLHDGSKEFAQNDVDFSKYVISTENKDIGEKLSEIGGRLDYPRLTKELAQEIESIWKDAAIQETYARGNELQVPDCTHYFMENLQRLSDANYVPTKEDVLLARVRTTGVVEIQFSPVGENKKSGEVYRLFDVGGQRNERRKWIHLFEGVSAVIFCVAISEYDQTLFEDENKNRMMETKELFEWVLKQQCFEKTSFMLFLNKFDIFEKKILDVPLNVCEWFKDYQPVSTGKQEIEHAYEFVKKKFEESYFQSTAPDSVDRVFKIYRTTALDQKVVKKTFKLVDETLRRRNLFEAGLL

SEQ ID NO: 24031 - protein, 384 aa, Pisum sativum
MGLVCSRNRRYRDSDPEENAQAAEIERRIESETKAEKHIQKLLLLGAGESGKSTIFKQIKLLFQTGFDEAELRSYTPVIFANVYQTIKVLHDGAKELAQNDLNSAKYVISDESKDIGEKLSEIGSRLDYPHLTKDLAKEIETLWEDAAIQETYARGNELQVPDCTKYFMENLQRLSDANYVPTKGDVLYARVRTTGVVEIQFSPVGENKRSGEVYRLFDVGGQRNERRKWIHLFEGVTAVIFCAAISEYDQTLFEDESKNRLMETKELFEWILKQPCFEKTSFMLFLNKFDIFEKKILNVPLNVCEWFKDYQPVSSGKQEIEHAYEFVKKKFEELYFQSSAPDRVDRVFKIYRTTALDQKVVKKTFKLVDETLRRRNLFEAGLL

SEQ ID NO: 24032 - protein, 353 aa, Homarus americanus
MACCLSEEAKEQKRINQEIERQLRKDKRDARRELKLLLLGTGESGKSTFIKQMRIIHGAGYSDEDKRGFIKLVFQNIFMAMQSMIRAMDLLQISYGDSANIEHADLVRSVDYESVTTFEEPYVTAMNSLWQDTGIQHCYDRRREYQLTDSAKYYLTDLDRIAAKDYVSTLQDILRVRAPTTGIIEYPFDLEEIRFRMVDVGGQRSERRKWIHCFENVTSIIFLVALSEYDQILFESDNENRMEESKALFKTIITYPWFQHSSVILFLNKKDLLEEKIMYSHLVDYFPEYDGPRKDAIAAREFILRMFVELNPDPEKIIYSHFTCATDTENIRFVFAAVKDTILQLNLKEYNLV

SEQ ID NO: 24033 - protein, 354 aa, Ustilago hordei
MGNCLSSSDQKEAKDRSVAIDKQIEQDSRQFKKECKILLLGSGESGKSTIVKQMKIIHQNGYSKDELLLYRLTVIKNLVDSAQAIVLALRKFKMEPEMPENRENVDVILQYRVDADPGATLDHPMARKVDSLWKDPIIPAIMERSSEFYLMDSAAYFFDNVNRIGQADYVPDENDVLRARSKTTGISETRFNMGQLSIHLFDVGGQRSERKKWIHCFEAVTSIIFCVALSEYDQVLLEESGQNRMAESLVLFESVVNSRWFLRTSVILFLNKIDIFKQKIPKQPLSKYFPEYSGGPDINKAAKYILWRFTQTNRARLSIYPHLTQATDTSNIRLVFAAVKETILTNALKDSGIL

SEQ ID NO: 24034 - protein, 379 aa, Homarus americanus
MGCFGSAGAKGDAEENKKRKEANKNINKQIQKDKQVYRATHRLLLLGAGESGKSTIVKQMRILHVDGFSEEEKREKIHAIRCNIRDAILTITGNMSTLTPPIALENPAHQFRVDYIQDVASQKDFDYPEEFYEHTEMLWKDKGVQACYERANEYQLIDCAKYFLDRVHIVRQTDYTPTEQDILRCRVLTLGIFETRFQVDKVNFHMFDVGGQRDERRKWIQCFNDVTAIIFVTACSSYNMVLREDPSQNRLRESLDLFKSIWNNRWLRTISVILFLNKQDLLAEKIRAGKSKLEDYFPDFARYQTPLDATVEPGEDPEVVRAKYFIRDEFLRISTASGDGKHYCYPHFTCAVDTENIRRVFNDCRDIIQRMHLRQYELL

SEQ ID NO: 24035 - protein, 354 aa, Oryzias latipes
MGCTLSTDDKAAQERSKMIDRNLRDDGEKAAREVKLLLLGAGESGKSTIVKQMKIIHEAGYSEEECKQYKAVVYSNTIQSIIAIIRAMGRLKIDFADQARADDARQLFILAGSTEEGFMTGELAGVIQRLWKDGGVQACFSRSREYQLNDSAAYYLNDLDRISHASYVPTQQDVLRTRVKTTGIVETHFTFKDLHFKMFDVGGQRSERKKWIHCFEGVTAIIFCVALSDYDLVLAEDEEMNGMHESMKLFDSICNNKWFTDTSIILFLNKKDLFEEKIKKSLLTICFPEYAGSNTYEEAAAYVQCQFEDLNKRKDTKEIYTHFTCATDTKNVQFVFDAVTDVIIKNNLKDCGLF

SEQ ID NO: 24036 - protein, 385 aa, Glycine max; identical to SEQ ID NO: 1664

SEQ ID NO: 24037 - protein, 384 aa, Solanum tuberosum
MGSLCSRNKHYSQADDEENTQTAEIERRIEQETKADKHIQKLLLLGAGDSGKSTIFKQIKLLFQTGFDEAELKNYIPVIHANVYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVLKVPLNTCEWFKDYQSVSTGKQEIEHAYEFVKKKFEESYFQCTAPDRVDRVFKIYRTTALDQKLVKKTFKLVDETLRRRNLFEAGLL

SEQ ID NO: 24038 - protein, 533 aa, Gallus gallus
MDGKSKMQAEKHLTGTLVLSVFTAVLGFFQYGYSLGVINAPQKVIEAHYGRMLGAIPMVRHATNTSRDNATITVTIPGTEAWGSSEGTLAPSAGFEDPTVSPHILTMYWSLSVSMFAVGGMVSSFTVGWIGDRLGRVKAMLVVNVLSIAGNLLMGLAKMGPSHILIIAGRAITGLYCGLSSGLVPMYVSEVSPTALRGALGTLHQLAIVTGILISQVLGLDFLLGNDELWPLLLGLSGVAALLQFFLLLLCPESPRYLYIKLGKVEEAKKSLKRLRGNCDPMKEIAEMEKEKQEAASEKRVSIGQLFSSSKYRQAVIVALMVQISQQFSGINAIFYYSTNIFQRAGVGQPVYATIGVGVVNTVFTVISVFLVEKAGRRSLFLAGLMGMLISAVAMTVGLVLLSQFAWMSYVSMVAIFLFVIFFEVGPGPIPWFIVAELFSQGPRPAAIAVAGFCNWACNFIVGMCFQYIADLCGPYVFVVFAVLLLVFFLFAYLKVPETKGKSFEEIAAAFRRKKLPAKSMTELEDLRGGEEA

SEQ ID NO: 24039 - protein, 180 aa, Medicago truncatula
MASSSPILLMIIFSMWLLISHSESTDYLIGDSHNSWKVPLPSRRAFARWASAHEFTVGDTILFEYDNETESVHEVNEHDYIMCHTNGEHVEHHDGNTKVVLDKIGVYHFISGTKRHCKMGLKLAVVVQNKHDLVLPPLITMPMPPSPSPSPNSSGNKGGAAGLGFIMWLGVSLVMMMFLI

SEQ ID NO: 24040 - protein, 268 aa, Medicago truncatula
MSSSSPILLMFIFSIWMLISYSESTDYLVGDSENSWKFPLPTRHALTRWASNYQFIVGDTITFQYNNKTESVHEVEEEDYDRCGIRGEHVDHYDGNTMVVLKKTGIHHFISGKKRHCRLGLKLAVVVMVAPVLSSPPPPPSPPTPRSSTPIPHPPRRSLPSPPSPSPSPSPSPSPSPSPRSTPIPHPRKRSPASPSPSPSLSKSPSPSESPSLAPSPSDSVASLAPSSSPSDESPSPAPSPSSSGSKGGGAGHGFLEVSIAMMMFLIF

SEQ ID NO: 24041 - protein, 197 aa, Sulfolobus acidocaldarius
MTQGPNYRIKFRRRREGKTDYYTRYTYVINNAIRFVPRLTNKYVIVSVSKFDQKGDIMIAYAHSIELVKKYGWKGDTNNTPAAYLTGYLAGLRAVKSGVKAAVSDIGLFVPVKGGRIFAVIKGAIDAGLKVPVGDLGKLKDRVNGSHISAYAQKLKNENQELYNKLFSSYIQRGLDPVLLPQHFEEVLNKIKENGGK

SEQ ID NO: 24042 - protein, 327 aa, Anopheles gambiae
MGFVKVVKNKQYFKRYQVRFRRRREGKTDYYARKRLIFQDKNKYNTPKFRLIVRLSNRDITCQIAYRRIEGDRIVCAAYSHELPRYGVKVGLTNYAAAYCTGLLVARRILQKLRLDTLYAGCTDVTGEEYLVEPVDEGPAAFRCYLDVGLARTTTGSRVFGAMKGAVDGGLNIPHSVKRFPGYSAENKSFNAEMHRDHIFGLHVANYMRTLEEEDEEAFKRQFSKYISLGIKADDIENIYKNAHASIRKIPPSRRNPRRRSPRSGGRWPSCRSPPARRRSRSTRPTSWPRSRPTSKPKRLPRRRRPFFFSSWWCIILVLPCSSPVQG

SEQ ID NO: 24043 - protein, 121 aa, Solanum melongena
SSKDSKQLDAEVHRKYIYGGHVAAYMNILMEDEPEKYQSHFSSYIKADLAPDNIEEMYKKVHAAIRPDPSPKKSQKQPPKTHKRYNLKKLTYEERKAKLIERLNALNAAGGNDDDDEEDDE

SEQ ID NO: 24044 - protein, 338 aa, Methanothermococcus thermolithotrophicus
MITAESEHKIAPWKIEEVNKLKELLKNGQIVALVDMMEVPARQLQEIRDKIRGTMTLKMSRNTLIERAIKEVAEETGNPEFAKLADYIDKGAAIITTDMNPFKLYKTLEESKSPAPIKGGAVAPCDIEVKAGSTGMPPGPFLGELKSVGIPAAIEKGKIGIKEDKVVAKAGEVVSHKLAVVLSALGIKPVTVGLNLLAAYEDGVIYTPDVLKIDEEEFVQKIQDAYSKAFNLSVNAAIPTAQTIETLLQKAFANARAVSIESAFLTEKTTDDILGKAYSQMLAVAREVGDDALDDELKEKLSTAVVETKAEVEEAKEEEKEEKKEEAAPAAAGLGLLF

SEQ ID NO: 24045 - protein, 387 aa, Spinacia oleracea
METSMACCSRSIVLPRVSPQHSSALVPSSINLKSLKSSSLFGESLRMTTKSSVRVNKAKNSSLVTKCELGDSLEEFLAKATTDKGLIRLMMCMGEALRTIGFKVRTASCGGTQCVNTFGDEQLAIDVLADKLLFEALNYSHFCKYACSEELPELQDMGGPVDGGFSVAFDPLDGSSIVDTNFSVGTIFGVWPGDKLTGVTGRDQVAAAMGIYGPRTTYVLALKDYPGTHEFLLLDEGKWQHVKETTEINEGKLFCPGNLRATSDNADYAKLIQYYIKEKYTLRYTGGMVPDVNQIIVKEKGIFTNVISPTAKAKLRLLFEVAPLGFLIEKAGGHSSEGTKSVLDIEVKNLDDRTQVAYGSLNEIIRFEKTLYGSSRLEEPVPVGAAA

SEQ ID NO: 24046 - protein, 440 aa, Pneumocystis carinii
SCRYFLAEWGRKEIELAENEMPGLISCRRNMRFKPLRVQIAGCLHMTIQTAVLIETLVELGAEVTWSSCNIFSTQDHAAAAIAASGISVFAWKGETEEEYLWCIETQLTSFKDGKHLNMILDDGGDVTSLVHNKYPDYLKNCKGISEETTTGVHQFYKMLKEGKLKVPAINVNDSVTKSKFDNLYGVSLVLIYKIISNIKLRCRESLIDGIKRATDIMIAAKVAIVAGFGDVGKGCAKALRGMGARVIITEIDPIVALQASMEGYQVAVMEEVADQADIFVTATGCKDIICERHFEAMKNDAIICNIGHFDVEIDVAWLIKKCSSISNIKPQVDRYLLGNGRNIILLAEGRLVNLGCATGHSSMVMSMSFTNQVLAQIALWTAQEGQYPLGVHFLPKKLDEEVARLHLSKLGKLTSLTPEQSAYLDIPIDGPYKSEHYRY

SEQ ID NO: 24047 - protein, 1049 aa, Oryza sativa
MAGNEWINGYLEAILDSGGAAGGGGGGGGVDPRSPAAGAASPRGPHMNFNPTHYFVEEVVKGVDESDLHRTWIKVVATRNARERSTRLENMCWRIWHLARKKKQLELEGILRISARRKEQEQVRRETSEDLAEDLFEGEKADTVGELAQQDTPMKKKFQRNFSELTVSWSDENKEKKLYIVLISLHGLVSGDNMELGRDSDTGGQVKYVVELARALAMMPGVYRVDLFTRQVSSPEVDWSYGEPTEMLTPVPLTEREAVRVLVRTLCAFRAVQGTSTSVKSPVALPPRVCRRSSRAYLNMSKALGEQVSNGKLVLPYVIHGHYADAGDVAALLSGALNVPMVLTGHSLGRNKLEQIMKQGRMSKEEIDSTYKIMRRIEGEELALDATEPVITSTRQENDEQWGLYDGFDVKLEKVLRARARRGVSCHGRFMPRMVVIPPGMDFSSVVVPEDTSDGDDGKDFEIASPRSLPPIWAEVMRFLTNPHKPMILALSRPDPKKNITTLVKAFGECRPLRELANLILIMGNRDDIDEMSAGNASVLTTVLKLIDKYDLYGSVAFPKHHKQSDVPEIYRLTGKMKGVFINPALVEPFGLTLIEAAAHGLPIVATKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLHLSIDGERGSSMNDAPSSDPQDSVQRIMNKIKRSSPADTDGAKIRQAAATATSGAMNKYPLLRRRRRLFVIAVDCYGDDGSASKRMLQVIQEVFRAVRSDSQMSRISGFALSTAMPLPETLKLLQLGKIPPTDFDALICGSGSEVYYPGTAQCVDAGGLRPDQDYLLHINHRWSHDGAKQTIANVAHDGSGTNVEPDVESCNPHCVSFFIKDPNKVRTADEMRERMRMRGLRCHLMYCRNATRLQVVPLLASRSQALRYLFVRWGLSVGNMYLIVGEHGDTDHEEMLSGLHKTVIIRGVTEKGSEQLVRSSGSYQREDVFPSESPLIAFTKGDLKAD

SEQ ID NO: 24048 - protein, 1053 aa, Solanum tuberosum
MAGNDWINSYLEAILDVGPGLDDKKSSLLLRERGRFSPTRYFVEEVITGFDETDLHRSWIRAQATRSPQRRNTRLENMCWRIWNLARQKKQLEGEQAQWMAKRRQERERGRREAVADMSEDLSEGEKGDIVADMSSHGESTRGRLPRISSVETMEAWVSQQRGKKLYIVLISLHGLIRGENMELGRDSDTGGQVKYVVELARALGSMPGVYRVDLLTRQVSSPEVDWSYGEPTELAPISTDGLMTEMGESSGAYIIRIPFGPREKYIPKEQLWPYIPEFVDGALNHIIQMSKVLGEQIGSGYPVWPVAIHGHYADAGDSAALLSGALNVPMLFTGHSLGRDKLEQLLAQGRKSKDEINSTYKIMRRIEAEELTLDASEIVITSTRQEIDEQWRLYDGFDPILERKLRARIKRNVSCYGRFMPRMAVIPPGMEFHHIVPHEGDMDGETEGSEDGKTPDPPIWAEIMRFFSNPRKPMILALARPDPKKNLTTLVKAFGECRPLRDLANLTLIMGNRDNIDEMSSTNSALLLSILKMIDKYDLYGQVAYPKHHKQSDVPDIYRLAAKTKGVFINPAFIEPFGLTLIEAAAYGLPMVATKNGGPVDIHRVLDNGLLVDPHDQQAIADALLKLVADKQLWAKCRANGLKNIHLFSWPEHCKTYLSRIASCKPRQPRWLRSIDDDDENSETDSPSDSLRDIHDISLNLRFSLDGEKNDNKENADNTLDPEVRRSKLENAVLSLSKGALKSTSKSWSSDKADQNPGAGKFPAIRRRRHIFVIAVDCDASSGLSGSVKKIFEAVEKERAEGSIGFILATSFNISEVQSFLLSEGMNPTDFDAYICNSGGDLYYSSFHSEQNPFVVDLYYHSHIEYRWGGEGLRKTLVRWAASIIDKNGENGDHIVVEDEDNSADYCYTFKVCKPGTVPPSKELRKVMRIQALRCHAVYCQNGSRINVIPVLASRSQALRYLYLRWGMDLSKLVVFVGESGDTDYEGLIGGLRKAVIMKGLCTNASSLIHGNRNYPLSDVLPFDSPNVIQADEECSSTEIRCLLEKLAVLKG

SEQ ID NO: 24049 - protein, 1059 aa, Vicia faba
MAGNDWLNSYLEAILDVGPGLDDAKSSLLLRERGRFSPTRYFVEEVIGFDETDLYRSWVRASSSRSPQERNTRLENMCWRIWNLARQKKQLESEAVQRVNKRRLERERGRREATADMSEDLSEGERGDPVSDVSTHGGGDSVKSRLPRISSADAMETWVNSQKGKKLYIVLISIHGLIRGENMELGRDSDTGGQVKYVVELARALGSMPGVYRVDLLTRQVSSPDVDWSYGEPTEMLAPRNTDEFGDDMGESSGAYIIRIPFGPRNKYIPKEELWPYIPEFVDGAMGHIIQMSKALGEQIGSGHAVWPVAIHGHYADAGDSAALLSGALNVPMIFTGHSLGRDKLEQLLKQGRLSTDEINSTYKIMRRIEAEELALDGTEIVITSTRQEIEEQWRLYNGFDPVLERKIRARIRRNVSCYGRYMPRMSVIPPGMEFHHIAPLDGDIETEPEGILDHPAPQDPPIWSEIMRFFSNPRKPVILALARPDPKKNITTLVKAFGECRPLRELANLTLIMGNRDGIDEMSSTSSSVLLSVLKLIDKYDLYGQVAYPKHHKQSDVPDIYRLAAKTKGVFINPAFIEPFGLTLIEAAAYGLPMVATKNGGPVDIHRVLDNGLLIDPHDEKSIADALLKLVSNKQLWAKCRQNGLKNIHLFSWPEHCKTYLSKIATCKPRHPQWQRSEDGGESSESEESPGDSLRDIQDLSLNLKFSLDGERSGDSGNDNSLDPDGNATDRTTKLENAVLSWSKGISKDTRRGGATEKSGQNSNASKFPPLRSRNRLFVIAVDCDTTSGLLEMIKLIFEAAGEERAEGSVGFILSTSLTISEIQSFLISGGLSPNDFDAYICNSGSDLYYPSLNSEDRLFVGDLYFHSHIEYRWGGEGLRKTLIRWASSITDKKSENNEQIVSPAEQLSTDYCYAFNVRKAGMAPPLKELRKLMRIQALRCHPIYCQNGTRLNVIPVLASRSQALRYLYVRWGFELSKMVVFVGECGDTDYEGLVGGLHKSVILKGVGSRAISQLHNNRNYPLSDVMPLDSPNIVQATEGSSSADIQALLEKVGYHKG

SEQ ID NO: 24050 - protein, 1054 aa, Craterostigma plantagineum
MAGNDWINSYLEAILDVGPGIDEAKGSLLLRERGRFSPTRYFVEEVVSGFDETDLHRSWIRAQATRSPQERNTRLENMCWRIWNLARQKKQLENEEAQRMAKRRLERERGRREAVADMSEDLSEGEKGDIVVDHSHHGESNRGRLPRINSVDTMEAWMNQQKGKKLYIVLISLHGLIRGENMELGRDSDTGGQVKYVVELARALGSMPGVYRVDLLTRQVSSPEVDWSYGEPTEMLPPRNSENMMDEMGESSGSYIVRIPFGPKDKYVAKELLWPHIPEFVDGALGHIIQMSKVLGEQIGNGHPIWPAAIHGHYADAGDSAALLSGALNVPMLFTGHSLGRDKLEQLLRQGRLSRDEINSTYKIMRRIEAEELSLDASEMVITSTRQEIEEQWRLYDGFDPILERKLRARIKRNVSCYGRFMPRMMVIPPGMEFHHIVPHDGDLDAEPEFNEDSKSPDPHIWTEIMRFFSNPRKPMILALARPDPKKNLTTLVKAFGECKPLRELANLTLIMGNRDNIDEMSGTNASVLLSILKMIDKYDLYGLVAYPKHHKQSDVPDIYRLAAKTKGVFINPAFIEPFGLTLIEAAAHGLPIVATKNGGPVDIHRVLDNGILVDPHNQESIADALLKLVAEKHLWAKCRANGLKNIHLFSWPEHCKSYLSKLASCKPRQPRWLRNEEDDDENSESDSPSDSLRDIQDISLNLKFSFDGDKNESREKGGGSHPDDRASKIENAVLEWSKGVAKGPQRSMSIEKGEHNSNAGKFPALRRRKIMFVIAVDCKPSAGLSESVRKVFAAVENERAEGSVGFILATSFNISEIRHFLVSEKLNPTDFDAFICNSGGDLYYSSHHSEDNPFVVDLYYHSQIEYRWGGEGLRKTLVRWAASITDKKGEKEEHVIIEDEETSADYCYSFKVQKPNVVPPVKEARKVMRIQALRCHVVYCQNGNKINVIPVLASRAQALRYLYLRWGMELSKTVVVVGESGDTDYEEMLGGVHKTVVLSGVCTTATNLLHANRSYPLADVVCFDDLNIFKTHNEECSSTDLRALLEEHGAFKA

SEQ ID NO: 24051 - protein, 1081 aa, Craterostigma plantagineum
MAGNEWINGYLEAILDTGASAIDENSGGGKTAAAQKGRHHDHHFNPTKYFVEEVVSGVDESDLHRTWIKVVATRNTRERSSRLENMCWRIWHLTRKKKQLEWEDLQRLAARKWEREQGRKDVTEDMSEDLSEGEKGDVMGETPVALDSPRGNKKYHRNFSNLEVWSDSNKEKKLYIVLISLHGLVRGENMELGRDSDTGGQIKYVVEVARALAKMPGVYRVDLFTRQISSPEVDWSYAEPTEMLSSSSTTAGEAHEPEEEEEEEDLGEGSGAYIIRIPFGPRDKYLRKELLWPHIQEFVDGALSHIVNMSKALGDQIGGGQPVWPYVIHGHYADAGDSAALLSGALNVPMVLTGHSLGRNKLEQLLKQGRQTKEDINSMYRIMRRIEAEELSLDAAELVITSTKQEIEEQWGLYDGFDVKLERVLRARARRGVNCHGRFMPRMAVIPPGMDFSNVVVPEDGSEGDGDLATLTEATSPRSVPAIWADVMRFLTNPHKPMILALSRPDPKKNITTLVKAFGECRPLRELANLTLIMGNRDDIDEMSGGNASVLTTVLKLIDRYDLYGQVAFPKHHKQSDVPEIYRLASKTKGVFINPAFIEPFGLTLIEAAAHGLPMVATKNGGPVDIHRALNNGLLVDPHDQDAIANALLKLVSEKNLWNECRKNGLKNIHLFSWPEHCRTYLTRVAACRMRHPQWKTDTPLDETAIDDSLNDSLKDVLDMSLRLSVDGEKMSVNESSSVELPGGEAAELPDQVRRVLNKIKRQDSGPAQREAEGKAGDVPGKYPMLRRRRKLFVIALDCYDLKGNPDKKMILSIQEIVRAVRLDPQMSRFSGFALSTAMPVAELADFLKAGDVKVNDFDALICSSGSEVYYPGTYGEESGKLYLDPDYTSHIEYRWGGDGLKKTISKLMNTAEDGKSSVASSPIELVAKSSNSHCLSYAIKDPSKAKKVDDMRQKLRMRGLRCHLMYCRNSTSMQVVPLLASRSQALRYLFVRWRLSVANMYVILGETGDTDYEELISGTHKTLIMRGVVEKGSEELLRTAGSYLRDDVIPQDTPLIAYADKGAKAEHIVETFRQLSKAGM

SEQ ID NO: 24052 - protein, 1057 aa, Citrus unshiu
MAGNDWINSYLEAILDVGPGLDDAKSSLLLRERGRFSPTRYFVEEVITGFDETDLHRSWVKAQATRSPQERNTRLENMCWRIWNLARQKKQLEGEAAQRMAKRRLERERGRREATADMSEDLSEGEKGDIVSDVSAHGDSTRSRLPRISSVDAMETWISQQKGKKLYIVLISIHGLIRGENMELGRDSDTGGQVKYVVELARALGSMPGVYRVDLLTRQVSAPDVDWSYGEPTEMLTPRNSDDFMDDMGESSGAYIIRIPFGPKDKYIAKELLWPHIPEFVDGALNHIIRMSNVLGEQIGGGKPVWPVAIHGHYADAGDSAALLSGALNVPMLFTGHSLGRDKLEQLLKQARLSRDEINATYKIMRRIEAEELSLDASEIVITSTRQEIEEQWRLYDGFDPVLERKLRARIKRNVSCYGKFMPRMAIIPPGMEFHHIVPQDGDMDGETEGNEDNPASPDPPIWSEIMRFFTNPRKPVILALARPDPKKNITTLVKAFGECRPLRELANLTLIMGNRDGIDEMSSTSASVLLSVLKLIDKYDLYGQVAYPKHHKQSDVPEIYRLAAKTKGVFINPAFIEPFGLTLIEAAAHGLPIVATKNGGPVDIHRVLDNGLLVDPHDQQSIADALLKLVAGKQLWARCRQNGLKNIHLFSWPEHCKTYLSRIAGCKPRHPQWQRTDDGGETSESDSPGDSLRDIQDISLNLKFSLDGEKSGASGNDDSLDSEGNVADRKSRLENAVLAWSKGVLKDTRKSGSTDKVDQNTGAAKFPALRRRKHIFVISVDCDSTTGLLDATKKICEAVEKERTEGSIGFILSTSMTISEIHSFLVSGHLSPSDFDAFICNSGSDLYYSTLNSEDGPFVVDFYYHSHIEYRWGGEGLRKTLVRWASQVTDKKAESGEKVLTPAEQLSTNYCYAFSVQKPGMTPPVKELRKVLRIQALRCHVIYCQNGSRVNVIPVLASRSQALRYLYLRWGVELSKMVVFVGESGDTDYEGLLGGVHKTVILKGICSSSSNQIHANRSYPLSDVMPIDSPNIVQTPEDCTTSDIRSSLEQLGLLKV

SEQ ID NO: 24053 - protein, 809 aa, Pisum sativum
MSTHPKFTRVPSIRDRVQDTLSAHRNELISLLSRYVAQGKGILQPHNLIDELDNILGEDHATLDLKNGPFGQIINSAQEAIVLPPFVAIAVRPRPGVWEYVRVNVFELSVEQLSVSEYLSFKEELVEGKSNDNIILELDLEPFNASFPRPTRSSSIGNGVQFLNRHLSSNMFRNKDCLEPLLDFLRVHTYKGHALMLNDRIQSISKLQSALVKAEDHLSKLAPDTLYSEFEYELQGTGFERGWGDTAARVLEMMHLLLDILQAPDPSTLETFLGRVPMVFNVVILSPHGFFGQANVLGLPDTGGQVVYILDQVRALESEMLVRIKKQGLDFTPRILIVTRLIPDAKGTTCNQRLERVSGTEYTHILRVPFRSEKGILRKWISRFDVWPFLETFAEDVASEIAAELQCYPDFIIGNYSDGNLVASLLAYKMGVTQCTIAHALEKTKYPDSDIYWKKFEDKYHFSCQFTADLIAMNNADFIITSTYQEIAGTKNTIGQYESHTAFTLPGLYRVVHGIDVFDPKFNIVSPGADMTIYFPYSDKEKRLTALHSSIEKLLYGTEQTDEYIGSLTDRSKPIIFSMARLDRVKNITGLVESYAKNSKLRELVNLVVVAGYIDVKKSSDREEIEEIEKMHDLMKQYNLNGEFRWITAQTNRARNGELYRYIADTKGAFVQPAFYEAFGLTVVEAMTCGLPTFATNHGGPAEIIEHGVSGFHIDPYHPDQASELLVDFFQRCKEDPNHWNKVSDGGLQRIYERYTWKIYSERLMTLAGVYSFWKYVSKLERRETRRYLEMFYILKFRDLANSVPIAKG

SEQ ID NO: 24054 - protein, 801 aa, Daucus carota
MAQPLLSLRQRFESTFSSHRQEIFMFLSRIQSLGNGILKPHQLFSEFQAISKIDRLKLEDSALVQLLNSAQEAIVCSPWIALAIRLRPGVWEYVRLNVHQLVVEELTVPDYLYLKEELVNASSNGNFVLELDFAPFTASIPRPTLTKSIGNGVEFLNRHLSAKMFQDKDSMHPLLDFLRLHHHNGRTLMLNNRVQTVNGLQDILRIAGEYLSKLPSDTPYSDFEHKFQEIGFERGWGDTAEHVSEMFHMLLDLLEAPDACTLETFLGKIPMIFNVVILSPHGYFAQENVLGYPDTGGQVVYILDQVPAMEREMTKRIKEQGLDIIPRILIVTRLLPDAVGTTCNLRLEKVFGAEHSHILRVPFRTEKGILRKWISRFEVWPYMETFTEDVAKEIALELKAKPDLIIGNYSEGNLVASLLANKLGVTQCTIAHALEKTKYPDSDIYWEKFDKKYHFSSQFTADLIAMNHTDFIITSTFQEIAGSKDTVGQYESHTAFTMPGLYRVVHGIDVFDPKFNIVSPGADTSVYYPYTEKKRRLTALHPEIEDLLFSSVENKEHICVLKDRYKPILFTMARLDNVKNLTGIVEWYAKNPKLRELVNLVVVGGDRRKESKDLEEQAQMKKMYGLIDTYKLNGQFRWISAQKNRVRNGELYRCIADTKGAFVQPAFYEAFGLTVIEAMTCGLPTFATIHGGPAEIIVHGTSGFHIDPYHGEKAAELIVNFFERCKTEPSHWETISAGGLKRIQEKYTWQIYSERLLTLGGVYGFWKHVSKLDRIEIRRYLEMFCALKYRNLAESVPLAVD

SEQ ID NO: 24055 - protein, 805 aa, Medicago sativa
MATERLTRVHSLKERLDETLTANRNEILALLSRLEAKGKGILQHHQVIAEFEEIPEESRQKLTDGAFGEVLRSTQEAIVLPPWVALAVRPRPGIWEYLRVNVHALVVENLQPAEFLKFKEELVDGSANGNFVLELDFEPFTASFPRPTLNKSIGNGVHFLNRHLSAKLFHDKESLHPLLEFLRLHSYKGKTLMLNDRIQNPDSLQHVLRKAEEYLSTIDPETPYSEFEHRFQEIGLERGWGDTAERVLESIQLLLDLLEAPDPCTLESFLDRIPMVFNVVILSPHGYFAQDDVLGYPDTGGQVVYILDQVRALESEMLSRIKKQGLDIIPRILIITRLLPDAVGTTCGQRLEKVYGTEHCHILRVPFRDEKGIVRKWISRFEVWPYLETYTEDVAHELAKELQSKPDLIVGNYSDGNIVASLLAHKLGVTQCTIAHALEKTKYPESDIYWKKFEEKYHFSCQFTADLFAMNHTDFIITSTFQEIAGSKDKVGQYESHTAFTLPGLYRVVHGIDVFDPKFNIVSPGADQTIYFPYTETSRRLTSFYPEIEELLYSSVENEEHICVLKDRNKPIIFTMARLDRVKNITGLVEWYGKNAKLRELVNLVVVAGDRRKESKDLEEIAEMKKMYGLIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKADPSHWDKISQGGLQRIEEKYTWTIYSQRLLTLTGVYGFWKHVSNLDRLESRRYLEMFYALKYRKLAESVPLAVE

SEQ ID NO: 24056 - protein, 820 aa, Tulipa gesneriana
MADRAMTRVHSVRERLTDTLSAHKNELLALFSRFVKQGQGMLQPHQLLTEYEAVIPAADREKLKDGVFEDVLKAAQEAIVIPPWVALAIRPRPGVWEYVRVNVSELAVEELTVPEYLQFKEELVDGSGQSNFTLELDFEPFNASFPRPSLSKSIGNGVQFLNRHLSSKLFHDKESMYPLLNFLKEHHYNGTSMMLNDRIQTLGALQASLRRADEYVLSLPLDTPYSDFGHRFQELGLEKGWGDNAKRVHENLHLLLDLLEAPDPCTLENFLGTIPMVFNVVILSPHGYFAQANVLGYPDTGGQVVYILDQVRAMESEMLLRIKQQGLDITPRILIVTRLLPDAVGTTCGQRLEKVLGTEHTHILRVPFRTEHGILRKWISRFEVWPYLETYAEDVANEVAGELQATPDLIIGNYSDGNLVASLMAHKLGVTQCTIAHALEKTKYPNSDLYWKKFEKQYHFSCQFTADLIAMNHADFIITSTFQEIAGSKDTVGQYESHTGFTLPGLYRVVHGIDVFDPKFNIVSPGADMSIYFPYTEAEKRLTALHPEIEELLYSSAESTEYKFGLKDKTKPIIFSMARLDRVKNMTGLVELYAKNDRLKELVNLVVVCGDHAKASKDLEEQAELKKMYSLIEEYKLDGHIRWISAQMNRVRNGELYRYIADSKGVFVQPAFYEAFGLTVVESMTCGLPTFATCHGGPAEIIVHGVSGYHIDPYHGDKAAELLVDFFEKSKKDQTHWDAISNGGLKRIYEKYTWKIYSERLLTLAGVYGFWKYVSNLDRRETKRYLEMFYALKYRNLAKSVPLAVDGEAAVNGKICTLGC

SEQ ID NO: 24057 - protein, 805 aa, Tulipa gesneriana
MTERRLTRIHSIKERLGDSLSHHPNELLALFSRFIKQGKGMLERHQLLTEYESVIPEADREKLKDGVFEDTLRASQEAIVIPPWVALAIRPRPGVWEYVRVNVNELAVEECSEYLKFKEDLVDRSSQSNFVLEMDFEPFNANVPRPSLSKSIGNGVQFLNRHLSSKLFHDKESLYPLLNFLREHNYKGTTLMLNDRLQSLSALQTALRKADRYLLSISKDTPYSEFNHSFQVLGLEKGWGDTASRVSENIHLLLDLLEAPDPSTLEKFLGTIPMVFNVVILSPHGYFAQANVLGYPDTGGQVVYILDQVRALETEMLLKIKQQGLDITPRILIVTRLLPDAVGTTCGQRLERVLGTEHTHILRVPFRTDKGILRKWISRFEVWPYLETYAEDVAHELAGEMQATPDLIIGNYSDGNLVASLLAHRLGITQCTIAHALEKTKYPNSDIYLKKFDDQYHFSCQFTADLIAMNQSDFIITSTFQEIAGSKDTVGQYESHTAFTLPGLYRVVHGIDVFDPKFNIVSPGADMSIYYPYFEQEKRLTALHAEIEELLYSSVENEEHKFVLKDRNKPIIFSMARLDRVKNMTGLVELYGKNDRLKELVNLVVVAGDHGKESKDLEEQAELKKMYKLIEEYKLQGHIRWISAQMNRVRNGELYRYIADTKGAFVQPAFYEAFGLTVVESMTCGLPTFATCHGGPAEIIVHGVSGFHIDPYHGDKASEQLVSFFEKCKEDPAHWEKISQGGLQRIYEKYTWKLYSERLMTLAGVYGFWKYVSNLDRRETRRYLEMFYALKYRNLAKSVPLAIDN

SEQ ID NO: 24058 - protein, 766 aa, Beta vulgaris
AGGKQILSDGPFSEVLRSAQEAIVVPPFVAIAVRPRPGVWEYVRVNVSELNVEQLTVSEYLHFKEELVDGKADDHYVLELDFEPFNESVPRPTRSSSIGNGVQFLNRHLSSSMFCNKDCLEPLLDFLRVHKHKGVVMMLNDRIQTIQRLQSALSKAEDYLIKLPADTPYSEFEFVIQGMGFERGWGDTAERVLEMMHLLLDILQAPDPSTLETFLGRLPMVFNVVILSVHGYFGQAHVLGLPDTGGQIVYILDQVRSLEHEMLQRIKKQGLDVTPRILIVSRLIPDAKGTTCNQRMEKVSGTEHASILRVPFRSEKGILRKWISRFDVWPYLETFTEDAAGEIIGELQGRPDLIIGNYSDGNIVASLLSHKMGVTQCNIAHALEKTKYPDSDIYWKRFEDKYHFSCQFSADLMAMNHADFIITSTYQEIAGTKNTVGQYESHKAFTFPGLYRVVHGIDVFDPKFNIVSPGADMAIYFPFSEKDVTCLTSLHRLIEQLLFKPEQNEEHIGVLDDTSKPIIFSMARLDRVKNITGLVECYGKNAKLRELANLVVVAGYNDVKKSNDREEIAEIEKMHRLIQEYNLRGQFRWIASQTNRVRNGELYRYICDKGGIFAQPAFYEAFGLTVVEAMTCGLPTFATCHGGPAEIIEDGVSGFHIDPYHADQAEKMTEFFVKCREDPNYWTKISAGGLLRIKERYTWQKYSERLMTLAGVYGFWKYVSKLERRETRRYLEMFYILKFRDLANSVPLATDEEPSTTDAVATFRGP

SEQ ID NO: 24059 - protein, 816 aa, Oryza sativa; identical to SEQ ID NO: 4014

SEQ ID NO: 24060 - protein, 506 aa, Petroselinum crispum
MMDFVLLEKALLGLFIATIVAITISKLRGKKLKLPPGPIPVPVFGNWLQVGDDLNQRNLVDYAKKFGDLFMLRMGQRNLVVVSSPELAKDVLHTQGVEFGSRTRNVVFDIFTGKGQDMVFTVYSEHWRKMRRIMTVPFFTNKVVQQYRFGWEDEAARVVEDVKANPEAATNGIVLRNRLQLLMYNNMYRIMFDRRFESVDDPLFLKLKALNGERSRLAQSFEYHFGDFIPILRPFLRGYLKLCQEIKDKRLKLFKDYFVDERKKLESIKSVDNNSLKCAIDHIIEAQQKGEINEDNVLYIVENINVAAIETTLWSIEWGIAELVNNPEIQKKLRHELDTVLGAGVQICEPDVQKLPYLQAVIKETLRYRMAIPLLVPHMNLHDAKLAGYDIPAESKILVNAWWLANNPAHWNKPDEFRPERFLEEESKVEANGNDFKYIPFGVGRRSCPGIILALPILGIVIGRLVQNFELLPPPGQSKIDTAEKGGQFSLQILKHSTIVCKPRSL

SEQ ID NO: 24061 - protein, 354 aa, Pseudomonas sp. HR199
MFPKNAWYVACTPDEIADKPLGRQICNEKIVFYRGPEGRVAAVEDFCPHRGAPLSLGFVRDGKLICGYHGLEMGCEGKTLAMPGQRVQGFPCIKSYAVEERYGFIWVWPGDRELADPALIHHLEWADNPEWAYGGGLYHIACDYRLMIDNLMDLTHETYVHASSIGQKEIDEAPVSTRVEGDTVITSRYMDNVMAPPFWRAALRGNGLADDVPVDRWQICRFAPPSHVLIEVGVAHAGKGGYDAPAEYKAGSIVVDFITPESDTSIWYFWGMARNFRPQGTELTETIRVGQGKIFAEDLDMLEQQQRNLLAYPERQLLKLNIDAGGVQSRRVIDRILAAEQEAADAALIARSAS

SEQ ID NO: 24062 - protein, 315 aa, Escherichia coli [sequence omitted]

SEQ ID NO: 24063 - protein, 462 aa, Escherichia coli
MTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSQMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 24064 - protein, 337 aa, Oryctolagus cuniculus
ADKAPFDTDISTMTRFVMEEGRKAGGTGEMTQLLNSLCTAVKAISTAVRKAGIAHLYGIAGSTNVTGDQVKKLDVLSNDLVMNMLKSSFATCVLVSEEDKNAIIVEPEKRGKYVVCFDPLDGSSNIDCLVSIGTIFGIYRKKSTDEPSTKDALQPGRNLVAAGYALYGSATMLVLAGGSGVNSFMLDPAIGEFILVDKNVKIKKKGNIYSLNEGYAKDFDPAVTEYIQKKKFPPDNSSPYGARYVGSMVADVHRTLVYGGIFLYPANKKSPDGKLRLLYECNPMAFIMEKAGGMATTGKEAILDIVPTDIHQRAPVILGSPDDVQEFLEIYKKHAVK

SEQ ID NO: 24065 - protein, 415 aa, Spinacia oleracea
MASIGPATTTAVKLRSSIFNPQSSTLSPSQQCITFTKSLHSFPTATRHNVASGVRCMAAVGEAATETKARTRSKYEIETLTGWLLKQEMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWDDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 24066 - protein, 360 aa, Amycolatopsis methanolica
PQTVRGVIARSKGAPVELTDIVIPDPGPSEVTALIATCAVCHTDLTYREGGINDEFPFLLGHEAAGTVESVGEGVDSVQPGDYVVLNWRAVCGQCRACKRGRPQYCFSTFNATQKMTLTDGTELTPALGIGAFADKTLVHAGQCTKVDPAADPAVAGLLGCGVMAGLGAAVNTGAVSRGDSVAVIGCGAVGDAVIAGARLAGANKIIAVDRDAKKLEWATELGATHTVNATETDVVEAVQALTGGFGADVVIDAVGRPETWKQAFYARDLAGTVVLVGVPTPDMRLEMPLLDFFSRGGALKSSWYGDCLPERDFPVLIDLHLQGRLPLDKFVTERISLDDVEKAFHTMHAGEVLRSVVVW

SEQ ID NO: 24067 - protein, 258 aa, Homo sapiens [sequence omitted]

SEQ ID NO: 24068 - protein, 46 aa, Oryctolagus cuniculus
GFVKVVKNKAYFKRYQVKFRRRREGKTDYYARKRLVIQDKNKYNTP

SEQ ID NO: 24069 - protein, 304 aa, Oryza sativa
MGGFVKTQKTNAYYKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPYHAKSTKKEPATHKRYNLKKLTYEQRKASLVERLNALNSSAGADDDDEEEDDE

SEQ ID NO: 24070 - protein, 805 aa, Glycine max; identical to SEQ ID NO: 1391

SEQ ID NO: 24071 - protein, 275 aa, Escherichia coli
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 24072 - protein, 491 aa, Drosophila melanogaster
MASFQIHQDMSNKENPGIKIPAGVKNTKQPLAVIGGKAEKNALAPRANFAVLNGNNNVPRPAGKVQVFRDVRNLNVDENVEYGAKKSNVVPVVEQFKTFSVYEDNNDTQVAPSGKSLASLVDKENHDVKFGAGQKELVDYDLDSTPISVTDVQSPMSVDRSILGVIQSSDISVGTETGASPTGRVKELPPRNDRQRFLEMVQYQMDILEYFRESEKKHRPKPLYMRRQKDISHNMRSILIDWLVEVSEEYKLDTETLYLSVFYLDRFLSQMAVVRSKLQLVGTAAMYIAAKYEEIYPPEVGEFVFLTDDSYTKAQVLRMEQVILKILSFDLCTPTAYVFINTYAVLCDMPEKLKYMTLYISELSLMEGETYLQYLPSLMSSASVALARHILGMEMWTPRLEEITTYKLEDLKTVVLHLCHTHKTAKELNTQAMREKYNRDTYKKVAMMESVEMSKDDFDQLCEAYNCKQKEDEQQQPDINTKSNVNLFYKF

SEQ ID NO: 24073 - protein, 362 aa, Shigella flexneri
MFRQGITGRSHLMSQNTLKVHDINEDAEFDENGVEVFDEKPLVEEEPSDNYLAEEELLSQGATQLVLDATQLYLGKIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTVRELSHKLDYEPSAVEIAEQLDKPVDDVSRMLRLNERITSVDTPLGGDSEKALLDILADEKENGPEDTTQDDDMKQSIVKWLFELNAKQREVIARRFGLLGYEAATLEDVGREIGLTRERVRQIQVQGLRRLREILQTQGLNIEALLPRVSKDLSERPLSSEAGFFCAQ

SEQ ID NO: 24074 - protein, 169 aa, Leavenworthia stylosa
NTEIVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVPKVIAEMTNGGVDRSVECTGSVQAMIQAFECVHD

SEQ ID NO: 24075 - protein, 169 aa, Leavenworthia stylosa
NTDRVGMIHDGESRFSIKGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 24076 - protein, 169 aa, Leavenworthia stylosa
DTDRVGMIHDGESRFSIKGKPIHHFLGTSTFSEYTVVHSGQVAKINPEAPLDKVCIVSCGLSTSLGATLNVAKPKKGQSVAVFGLGAVGLGAAEGARIAGASRIIGVDLNSNRFEQAKKFGVTEFVNPKEHDKPVQQVIAEMTNGGVDRSVECTGSVRAMIQAFECVHD

SEQ ID NO: 24077 - protein, 252 aa, Lycopersicon esculentum
  unsure (1)..(252): unsure at all Xaa locations
MEKEREKQVYLARLAEQAERYDEMVEAMKAIAKMDVELTVEERNLVSVGYKXVIGARRASWRILSSIEQKEESKGHEQNVKRIKTYRQRVEDELTKICSDILSVIDEHLVPSSTTGESTVFYYKMKGDYYRYLAEFKAGDDRKEASEQSLKLYEAATATASSDLAPTHPIRLGLALNFSVFYYEILNSPERACHLAKQAFDEAIAELDSLSEESYKDSTLIMQLLRDNLTLWTSDLEEGGEHSKGDERQGEN

SEQ ID NO: 24078 - protein, 313 aa, Cicer arietinum
ETVAIKKVLQDKRYKNRELQTMRLLDHPNVVTLKHCFFSTTEKDELYLNLVLEYVPETVYRVIRHYSKMNQRMPLIYVKLYFYQICRALAYIHNCVGVSHRDIKPQNLLVNPHTHQLKLCDFGSAKVLVKGEPNISYICSRYYKAPELIFGATEYTTAIDIWSAGCVLGELLLGQPLFPGASGVDQLVEIIKVLGTPTREEIKCMNPNYTEFKFPQIKAHPWHKIFRKRMPPEAVDLVSRLLQYSPNLRSTALEALVHPFLDELRDPNTRLPNGRHLPPLFNFKANELKGVSAEMLVKLIPLHARKQCALFVS

SEQ ID NO: 24079 - protein, 361 aa, Arabis stelleri
CKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFAGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHAVPFSEINKAFDYMLKGEG

SEQ ID NO: 24080 - protein, 361 aa, Arabis glabra
CKAAVAWKAGKPLVMEEVEVAPPQKHEVRIKILFTSLCHTDVYFWEAKGQTPLGPRIFGHEAGGIVESVGEGVTDLQPGDHVLPIFTGECGDCRHCHSEESNMCDLLRINTERGGMIHDGESRFSINGKPIYHFPGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPRDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 24081 - protein, 361 aa, Arabis flagellosa
CKAAVAWEAGKPLVMEEVEVAPPQKHEVRIKILFTSLCHTDVYFWEAKGQTPWFPRIFGHEAGGIVESIGEGVTDLAPGDHVLPIFTGECGDCPHCHSEESNMCDLLRINTERGGMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 24082 - protein, 361 aa, Arabidopsis lyrata subsp. kawasakiana
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVWIVSCGLSSGLGATLNVAKPKKGQSVAIFGLGAVGLAAAEGARIAGASRIIGVDLNPQRFDQAKEFGVTEFVNPRDHDKPVQQVIAEMTNGGVDRSVECTGSVQPMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 24083 - protein, 359 aa, Arabis hirsuta
  unsure (1)..(359): unsure at all Xaa locations
IRCKAAVAWEAGKPLVMEEVEVAPPQKHEVRIKILFTSLCHTDVYFWEAKEQTPLFPRIFGHEAGGIVESVGEGVTDLAPGDHVLPIFTGECGDCPHCHSEESNMCDLLRINTERGGMIHDGESRFSIDGEPIXHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTXGGVDRSVECTGSVQAMIQAFECVHDGWGVAVLVGVPSKDDAFKTHPMNSLNERTLKGTXFGNYNPKTDIPGVVEQYMNKELEIEKFITHAVPFSEINKAFDYML

SEQ ID NO: 24084 - protein, 363 aa, Crucihimalaya himalaica
  unsure (1)..(363): unsure at all Xaa locations
IRCKAAVAWEAGKPLVXEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSIKGKPIHHFLGTSTFSEYTVVHSGQVAKINPDAPLDKVCIVSCGLSTGLGAVLNVAKPKKGQSVAVFGLGAVGLAAAEGARIAGASRIIGVDLNSKRFDEAKKFGVTEFVNPRDHDKPVQQVIAEXTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSXINKAFDYMLKGES

SEQ ID NO: 24085 - protein, 363 aa, Olimarabidopsis pumila
IRCKAAVAWEAGKPLVMEEVEVAPPQNHEVRIKILFTSLCHTDVYFWEAKGQTPLFPRIFGHEAGGIVESVGEGVTDLQPGDHVLPIFTGECGDCRHCHSGESNMCDLLRINTERGGMIHDGESRFSINGKPIHHFLGTSTFSEYTVVQSGQVAKINPDAPLDKVCIVSCGLSTGLGATLNVAKPKKGQSIAIFGLGAVGLAAAEGARIAGASRIIGVDLNSKRFDQAKEFGVTEFVNPRDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 24086 - protein, 362 aa, Arabidopsis korshinskyi
RCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 24087 - protein, 363 aa, Crucihimalaya wallichii
IRCKAAVAWEAGKPLVMEEVEVAPPQKHEVRIKILFTSLCHTDVYFWEAKAQTPLFPRIFGHEAGGIVESVGEGVTDLQPGDHVLPIFTGECGDCRHCHSEESNMCDLLRINTERGGMIHDGESRFSIKGKPIHHFLGTSTFSGYTVVHSGQVAKINPDAPLDKVCIVSCGLSTGLGAVLNVAKPKKGQSVAVFGLGAVGLAAAEGARIAGASRIIGVDLNSQRFDEAKEFGVTEFVNPRDHDKPVQQVIAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 24088 - protein, 363 aa, Arabidopsis suecica
IRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSGYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPKDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 24089 - protein, 350 aa, Brassica oleracea
  unsure (1)..(350): unsure at all Xaa locations
PLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGAKIAGAGRIIGVDLNPKRFEEAKEFGVTEFVNPXEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 24090 - protein, 506 aa, Pseudomonas aeruginosa
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAESIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 24091 - protein, 507 aa, Candida albicans
MRSYKSSITDENELTKQRLRAKSIANLSSNHATAGQTSTSSQHREALTDLTSQENKNHPRVKLTQTNTNHHRNSSSSSNKIQIYQQIEQKKTDIHQFKKPRLEKVLLNDDDDETDDEFDDEEDKENRYHDLELNDDDSKHQLISEAFETIDDRGISEGENDTAQEARERLEEETQSHTQDMRSIYGVHVPMQPMWNNAIINELKYVIQKYSRNTLDENDEDTYDTTMVAEYSPEIFNYLHELENKFTPDPNYMDFQDDLKWEMRAVLIDWVVQVHARFNLFSETLYLTVNYIDRFLSKRRVSLSRFQLVGAVALFIAAKYEEINCPTVQEIAYMADNAYSIDEFLKAERFMIDVLEFDLGWPGPMSFLRRISKADDYDYETRTLAKYFLEITIMDSKFVASPPSWLAAGAHYISRILLGRGEWTELHVFYSGYTEKQLQPLADVLLENCRHAEINHKAIFEKYKERRYRKSSLFVQEYFRHIMSRVDLKTSFQQCGTLHFIQSSQNH

SEQ ID NO: 24092 - protein, 179 aa, Dendrobium grex Madame Thong-IN
LTLTKCCMQRGSHFRSRSGSQEARSGSSMSRCNSMDTKFCYYNNYNVNQPRHFCKNCQRYWTAGGSMRNVPVGAGRRKNKHTGSVYRHTVITPDSLASLQVDGPDLVDHKPLSPFKVNGTILKFGPDAPLCESMASILNLGEQNLSSQLDFTAGAENREETSCSSACKPVKKKDITQHN

SEQ ID NO: 24093 - protein, 490 aa, Helianthus tuberosus
MDFLIIVSTLLLSYILIWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSGKEFREVITNIMVDSAKTNLVDVFPVLKKIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 24094 - protein, 551 aa, Neurospora crassa
MSFSPPNKSADATIQITEMTRQGTPSSGEAAASTPSTSSTESGDKALEALGYTPVFKREFSRWSSFSFAVSISGVYGTLMSTWIYGLQAGGAAAIMWSWIIGGAGGWALAYSIAEIASAYPSSGAMYFTLKFLAPEEQVPFLCWIAGYLNLVGTVAGGASTEYAASQMLLAAVSITSNFSYVPTPTHVVGVMIGLTTIHAMINTLPTAWLNRLTSGYVVFHISVLLGACVTLLVQKRHDMHDLKYAFTNFQPSSGWSPPGFAFLFGCLTPAWIMTGCDGTARIAEEAKNPQMVVPRAIANATTFTYVIGFFFNLVLVVCMGDPKDLINSPSGQPVAQLFFNGMGRAPAIFFTLCGFGVMNLVAIPGMQAGSRTIFALSRDNLLPFSHIWVRISKRSQTPLIAVWTYAVLEIIINLLGLASSTAIGAVFNVCTVALNVSYVIPIICKMVYGRMQKGPWHMGKYSVWVNAFAVAWNTFMAVIFFFPTRVPVTPENMNYAIVVFFFVLILALVFWYTHGRHYYTGPLTHSPRATDMSVRTPRWSVIGFTSCTTL

SEQ ID NO: 24095 - protein, 353 aa, Magnaporthe grisea
MGCGMSTEEKEGKARNEEIENQLKRDRLQQRNEIKMLLLGAGESGKSTILKQMKLIHEGGYSRDERESFKEIIFSNTVQSMRVILEAMESLELPLEDQRMEYHVQTIFMQPAQIEGDVLPPEVGNAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSITLFLNKIDRFKEKLPISPMKNYFPDYEGGDDYAAACDYILNRFVSLNQHETKQIYTHFTCATDTTQIRFVMAAVNDIIIQENLRLCGLI

SEQ ID NO: 24096 - protein, 353 aa, Colletotrichum trifolii
MGCGMSTEDKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEAVWKDRGVQDCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 24097 - protein, 197 aa, Drosophila melanogaster
MGDQRGTRVYVGNLTDKVKKDDLEGEFTKYGKLNSVWIAFNPPGFAFVEFEHRDDAEKACDILNGSELLGSQLRVEISKGRPRQGRRGGPMDRGGRRGDFGRHSITSGGSGGGGFRQRGSSGSSSRHTERGYSSGRSGASSYNGREGGGSGFNRREVYGGGRDSSRYSSGSSASYGRTGGQSAGRFRSRSPVGNHRF

SEQ ID NO: 24098 - protein, 281 aa, Streptomyces ambofaciens
MATMTARITEHTTTGMPEVADPSKVAPKDARELSKLFFQQLSVLEEGTPEYQYARNTLIEMNMSLVRFAAGRFRSRGPEEMEDIVQVGMIGLIKAIDRFELTREVEFTSFAVPYIVGEIKRFFRDTSWAVHVPRRLQEARVQLARATEELRSRLGRNPTTKELSELMSLPEDEVVEARLAANGYNSASLDAAISGSEDGESALADFIGADDATLALVDDFHALAPMIAELDERDRQIIHWRFVEELTQKDIGERLGVSQMHVSRLISRLLARLREGMLTDH

SEQ ID NO: 24099 - protein, 281 aa, Streptomyces ambofaciens
MATMTAGITEHTTTGMPEVADPSKVAPKDARELSKLFFQQLSVLEEGTPEYQYARNTLIEMNMSLVRFAAGRFRSRGPEEMEDIVQVGMIGLIKAIDRFELTREVEFTSFAVPYIVGEIKRFFRDTSWAVHVPRRLQEARVQLARATEELRSRLGRNPTTKELSELMSLPEDEVVEARLAANGYNSASLDAAISGSEDGESALADFIGADDATLALVDDFHALAPMIAELDERDRQIIHWRFVEELTQKDIGERLGVSQMHVSRLISRLLARLREGMLSAA

SEQ ID NO: 24100 - protein, 345 aa, Leishmania donovani
MSALPQLYIQCNPLLDVSAPVDDAFLEKYKVQKTSACLMEEIHKGIFEELEQHPNVTYVPGGSGLNTARVAQWIAQAPKSSLFNYVGCASDDKYGKILKEAAEKNGVNMHLEYTTKAPTGSCAVCISGKDRSLVANLSAANLLSADHMHSSDVVETLKGCQLYYLTGFTLTIDVNYVLQVAEAARASGGQFMMNLSAPFVLQYFTESFNKAAPYLDVIFGNEVEAKALADAMKWNPASTHNLAKKAAMELPYSGTRDRIVDFTQGSQPTVYATRSGKTGSVTVQPIAHDIIVDLNGAGDAFVGGFLAAYAMSCSIQRCCEVGNYAAGVIIQHNGCTYPEKPSISP

SEQ ID NO: 24101 - protein, 255 aa, Malus x domestica
MGRGRVQLKRIENKINRQVTFSKRRSGLMKKAHEISVLCDAEVALIIFSTKGKLFEYSNDSCMERILERYERYSYTERQLLANDNESTGSWTLEHAKLKARVEVLQRNQRHYMGEDLQSLSLKELQNLEQQLDSALKHIRSRKNQVMYESISELQKKDKALQEQNNLLAKKVKEKENAVAQQAQLEHVQEQRLNSSSSLLPRALQSLNFGSGSNYQAIRSSEGIPGDNQQYGDETPTPHRPNMLLPAWIVRHLNE

SEQ ID NO: 24102 - protein, 917 aa, Pseudomonas tolaasii
MLRRMGIKGRVLLLTLLPTSLMALLLGGYFTWMQLSELQTQLLQRGEMIAEQLAPLVAPALSTRNTDLLERIATQSLEQPDVRAVSFLAPDRSPLAHAGPTMLNQPPVGNSSHLLQRSGNDATRYLLPVFGRHRNLAGELIPDEADRLLGWVEVELSHNGMLLRGYRSLFASLLLIAIGLICTAALALRISRTINSPIGQIKQAVAQLKDGNLETRLPPLGSQELDQLASGINRMAETLQNAQEELQHSIDQATEDVRQNLETIEIQNIELDLTRKEALEASRIKSEFLANMSHEIRTPLNGILGFTHLLQKSELSPRQLDYLGTIEKSADNLLGIINEILDFSKIEAGKLVLDSVPFNLRDLLQDTLTILAPAAHAKQLELVSLVYRDTPLALVGDPLRLKQILTNLISNAIKFTREGTIVARAMVEDEEEDSVQLRISVQDTGIGLSNQDVRALFQAFSQADNSLSRQPGGTGLGLVISKRLIEQMGGEIGVDSTPGEGSEFWISLNLPKTRDDVDDLPSAPLLGRRVAVLENHELARQALQHQLEDCGLEVTPFNTLESLTNGITSTHQTEQAIDLAVLGVTANDIPPERLNQHLWDLEHLGCKVLVLCPTTEQMLFNQSVPNPNSQLQAKPACTRKLRRALADLISPRPLRSEPGEPLSSRAPRVLCVDDNPANLLLVQTLLEDMGAKVLAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERGNDNLGHGVQLLVLDHEEGLRLAANKADLAADMLAMLLASLEADRLAITVAREAKDNNALIERVHRLHGATRYCGVPQLRAACQRAETLLKQDDAKAMAALDELDMAIARLASEARVNA

SEQ ID NO: 24103 - protein, 512 aa, Catharanthus roseus
MALEKLVLFDFLAAISILILVQKFIQIVFLRSSSRIRLPPGPKGWPIIGALPYLGTMPHSILANMAKKYGPIMYLKLGTNGMVVASTPDAVKAFLRTLDMNFSNRPIDAGATHLAYNAQDMVFAHYGPKWKLLRKLSNLHMLGGKALENWSNVRATELGYMLQAMYESSRKGETVVVPEMLTYAMANMIGQVILSRRVFVTKSLESNEFKDMVVELMTTAGYFNIGDFIPSIAWMDLQGIERGMKRLHKKFDALLTKMLEEHKSSSHKRKEKPDFLDYVLANRDNSEGERLTTTNIKALLLNLFTAGTDTSSSVIEWAISEMLKNPTILKRAQEEMDQVIGRNRRLMESDIPKLPYLQAICKETFRKHPSTPLNLPRIAQKDCQVNGYYIPKGTRLSVNIWAIGRDPNVWENPLEFNPDRFLSGKMAKIEPRGNDFELIPFGAGRRICAGTRMGIVLVEYILGTLVHSFDWKLPFDDINELNMDESFGLALQKAVPLVAMVSPRLPINAYSP

SEQ ID NO: 24104 - protein, 112 aa, Klebsiella pneumoniae
MKLVTVVIKPFKLEDVRERLSSMGIQGLTVTEVKGFGRQKGHAELYRGAEYSVNFLPKVKIDVAIADDQLDEVVDVISKAAYTGKIGDGKIFVAELQRVIRIRTGESDEAAL

SEQ ID NO: 24105 - protein, 1138 aa, Synechocystis sp.
MVISATVISMKSPLRRLLLSPVLPILIGAGLSVMTVHTWLFLYNQVQERLKQVLTNRLTNIHEQIENQLNIHVRQLEQMAGRWERSPTGTEQTDWRLDARAQAEGFDGYQTIQWVDPKFVVRWVEPLPDDEHDIDYANQYPHQIQSLELAARQKNTILSGVVDLDQGEKGFLVYVPLFIGDRFDGFVVGVFQLDQFIGSVRPLSGNKPDQDSGLRSFGLRIFEGNQLIYNDVPDDWEQDIVVTQELAWANSLPQAEAMTSRWQLQLVPGPILLDQYGSSQWILFSGLLMAWAVAIAVYYLQKSSKHSEQLSESIKQQQKVEEFLKSTLQELAVQKTALDEAAIVAITDTEGVITYVNDKFVEVSGYSREELIGNTHRLVSSGYHSPEFFQQFWQTIRAGKVWHGQINNRAKAGNTYWVDSTVVPFLDDNGNPYQYLAIRFEITSSKQAEKSLRESEARFRMMADTSPIMLWVADQDKKMTFVNQSWLEFRGATLAEESGNGYLEGIHPDDKGHYLGVYSQAFGDPRRFELEYRYRRVDQQYRWIVNVGVPRYLEDGKFMGYVGSCLDITDRKQAQDILQKKLNQILLMRKISQEIRRSLQPTLIFQTAARQVGNVFAVSRCLIHNYSEATTLQVPVVAEYLGGQFTSLLAGEIAVQQAYDPTIIQGDRAMAVVDLDQDLNSTHTKAFYQRFQVKSFLAVRTSYQGKANGIIALHQCDRQRVWTADEIELLEAIAEQMGIALAQAALLEKERERRRELAQKNLELEKATWAAEAANRAKGEFLAMMSHEIRTPMNGVIGMSELLIMTDLNLQQLDYVQTIRQSGETLLTIINDILDFSKIEADKLVLETQAFELRPLIETVLEMFGPIARAKHLELTYGIDPQTPARILGDQVRLRQILSNLIGNALKFTEKGEVVLTVKGEPFDPAESYHTILNLPHPSHRICFNLRDTGIGIPLDRQDRLFKSFSQVDSSTTRKYGGTGLGLVISQRLTQMMGGVLTVTSEPGVGSNFRFCILTTAQAPALAEADSVQQMKGKQVLIVDDNETNRRILQDQCQAWGLVCHCFTSGESALDWFARCPDLDAAILDLQMPNMDGITLAHHLRQFAQGKDLPIILLSSLVAGGMSCLYFRRCSINQCVSP

SEQ ID NO: 24106 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNLAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 24107 - protein, 2392 aa, Homo sapiens
DSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLGPWLRWSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEYLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 24108 - protein, 823 aa, Hordeum vulgare subsp. vulgare
MGETAGERALSRVHSVRERIGHSLSAHTNELVAVFSRLVNQGKGMLQPHQITAEYNAAIPEAEREKLKNTPFEDLLRGAQEAIVIPPWVALAIRPRPGVWEYVRVNVSELGVEELSVLRYLQFKEQLANGRTDNNFVLELDFGPFNASFPRPSLSKSIGNGVQFLNRHLSSKLFHDKESMYPLLNFLRAHNYKGMAMMLNDRIRSLGTLQGALRKAETHLSGLPADTPYSEFHHRFQELGLEKGWGDCAQRASETIHLLLDLLEAPDPSSLEKFLGTIPMVFNVVILSPHGYFAQANVLGYPDTGGQVVYILDQVRAMENEMLLRIKQQGLDITPKILIVTRMLPDAHGTTCGQRLEKVLGTEHTHILRVPFKTEDGIVRKWISRFEVWPYLEAYTDDVAHEIAGELQANPDLIIGNYSDGNLVACLLAHKLGVTHGTIAHALEKTKYPNSDLYWKKFEDHYHFSCQFTADLIAMNHADFIITSTFQEIAGKKDTVGQYESHMAFTMPGLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQELVNLVVVCGDHGKVSKDKEEQVEFKKMFDLIEKYNLSGHIRWISAQMNRVRNGELYRYICDMKGAFVQAAFYEAFGLTVIEAMTCGLPTFATAYGGPAEIIVNGVSGYHIDPYQNDKASALLVDFFGKCQEDPSHWNKISQGGLQRIEEKYTWKLYSERLMTLSGVYGFWKYVSNLDRRETRRTLKCSMPSSTAKWLQLSHWLLRARPRANDLSLPEK

SEQ ID NO: 24109 - protein, 589 aa, Trypanosoma brucei
MAQVGEVSTGTVTLDDEWTRGEATACGEAYAKVDDMDYDSFQRVVQKNRERGMPPPPRAVLKRVPESSDDFLRNFFLRNGMHRTMDIFEIEWYEKYGSKPLKDAPVSADNYLETAALHNRIDVLENQLRQHAELTTKTTKQFLQSKKERDFHRANHNRVVQEKNKLLKLLRQAQSHAEDLNPTLNELRQKCEALHKGKTMLSIERDKLEAKVLKLEKQVESLEQQLKLHETTRTKEPSPRQRDKQVAKVDGTKSGTKGGKSATRAGDAAADTFRWPPDERRRPANASGAFLAPTEPSSWICQSSFKAHSMPVTKIAMHPEKPAVVTSSDDGTWRLSALPQGELVMSGDGHKSWVSSVVMHPTGTMVATASGDKTVKLWDFAKSGCRLTLKAHCDGVWCLDFQETGLLLASGSLDQTARVWDVTTGKCRQTLRGHVDAVNGVAWRQYTNTLCTVSGDKTVSLWDVRANCCSQTLYGHRNAVQSVTTVGPTTNVATCDADGVVMLWDTRRMEQHLTVACGPYPANHIASDRNGTYLLVSSDDTNIKLIDVTKSTVTELVGHEDGVQCAVFDWSSNAFIVSGGSDGVVRYWC

SEQ ID NO: 24110 - protein, 846 aa, Brassica rapa
MKGVRNIYHHSYTLSFLLVFLVMILFRPAFSINTLSPTESLTISSNRTLVSPGDVFELGFFRTNSRWYLGMWYKKVSERTYVWVANRDNPISNSIGSLKILGNNLVLRGNSNKSVWSTNITRRNERSLVLAELLGNGNFVMRDSNNKDASEYLWQSFDYPTDTLLPEMKLGFQPKTGLNRFLTSWRSSDDPSSGDFSYKLEAQRLPEFYLWNKELFRVHRSGPWNGIRFSGIPEDQKLSYMVYNFTENSEEVAYTFLLTNSSIYSRLIVSSEGYIERQTWNPTLGMWNVFWSFPLDSQCESYRMCGPYSYCDVNTSPVCNCIQGFNPSNVEQWDLRSWSGGCIRRTRVSCSGDGFTRMKNMKLPETTMATVDRSIGVKECEKKCLSDCNCTAFANADIRNGGTGCVIWTGRLDDMRNYVADHGQDLYVRLAAADLVKKRNADGKIISSTVAVSVLLLLIMFCLWKRKQKRAKASATSIANRQRNQNLSMNGMVLLSKREFSVKNKIEELELPLIELEAVVKATDNFSNCNKLGQGGFGIVYKGRLLDGQEIAVKRLSETSVQGTDEFMNEVTLIARLQHINLVQILGCCIEADEKMLIYEYLENLSLDSYLFGKTQRSKLNWKERFDITNGVARGLLYLHQDSRFRIIHRDLKVSNILLDKNMIPKISDFGMARIFARDETEANTMKVVGTYGYMSPEYAMNGIFSEKSDVFSFGVIVLEIVTGKRNRGYNFLSYAWSHWKEGRTLELVDPVIVDSSLPSTFQPEEVLKCIQIGLLCVQELAEHRPTMSSVVWMLGSEATEIPHPKPPGCCIGRSPYELEPSSSRQCDEDESWTVNQYTCSVIDAR

SEQ ID NO: 24111 - protein, 143 aa, Cichorium intybus
MAREKIKIRKIDNITARQVTFSKRRRGLLKKAEELAVLCDADVALVIFSATGKLFEYASSSMQELLGKYKLHSTNNVNKVDEPSLDLQLVESQESRMSQEVLEKDRELSQLRGEDLQGLTLEELQRLESLLEGRLNRVAPDKG

SEQ ID NO: 24112 - protein, 327 aa, x Doritaenopsis sp.
MESGSFPVINMELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 24113 - protein, 380 aa, Lycopersicon esculentum
MSTTVGQVIRCKAAVAWEAGKPLVMEEVDVAPPQKMEVRLKILYTSLCHTDVYFWEAKGQNPVFPRILGHEAAGIVESVGEGVTDLAPGDHVLPVFTGECKDCAHCKSEESNMCSLLRINTDRGVMLNDGKSRFSINGNPIYHFVGTSTFSEYTVVHVGCVAKINPLAPLDKVCVLSCGISTGLGASLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPLNFLNERTLKGTFFGNYKPRSDIPCVVEKYMNKELELEKFITHTLPFAEINKAFDLMLKGEGLRCIITMAD

SEQ ID NO: 24114 - protein, 339 aa, Chlorella kessleri
MLSSALYQQAGLSGLLRASAMGPQTPFIASPKETQADPMAFVKDLLAGGTAGAISKTAVAPIERVKLLLQTQDSNPMIKSGQVPRYTGIVNCFVRVSSEQGVASFWRGNLANVVRYFPTQAFNFAFKDTIKGLFPKYSPKTDFWRFFVVNLASGGLAGAGSLLIVYPLDFARTRLAADVGSGKSREFTGLVDCLSKVVKRGGPMALYQGFGVSVQGIIVYRGAYFGLYDTAKGVLFKDERTANFFAKWAVAQAVTAGAGVLSYPFDTVRRRLMMQSGGERQYNGTIDCWRKVAQQEGMKAFFKGAWSNVLRGAGGAFVLVLYDEIKKFINPNAVSSASE

SEQ ID NO: 24115 - protein, 382 aa, Oryza sativa; identical to SEQ ID NO: 3287

SEQ ID NO: 24116 - protein, 252 aa, Brassica napus
MAYQMELGGESSPQRKAGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 24117 - protein, 420 aa, Rana esculenta
MKGPWLVLAALCLSLANLGPRGEDGLDFPEYDGEDRVIHISLKNYKAALKKYEVLALLYHEPIGDDKASQRQFEMEELILELAAQVLEDKGVGFGLVDSEDDAAVAKKLGLDEEDSIYVFKDDEMIEYDGEFSADTLVEFLLDVLEDPVEFIDGSHELAAFENLDDEPKLIGYFKNEDSEHYKAYEDAAEEFHPYIPFFATFDAKVAKTLTLKLNEIDYYEPFHDEPITIPSKPNSEKEIVDFLHQHKRPTLRKLRPDSMYETWEDDLNGIHIVAFAEEDDPDGYEFLQIIKEVAEDNTDNPDLSIIWIDPEDFPLLIPYWEEKFGIDLSRPHIGVVNVTDADSVWMDMDDEEDLPTVDELEDWIEDVLEGEVNTEDDDDDDDDDDDDDDDDDDDDDDDDDDDDDDDDDDDDDDDDDDDD

SEQ ID NO: 24118 - protein, 496 aa, Octopus dofleini
MAGLPPPNKTPEIKFTKIFINNQFVDSVNGKAYSVINPCTTKKICDVQEGSKADIDKAVQACKLAFKRGTPWRRMDASRRGHLLYRLADLFERDIAYLSSLETLNTGKPYKSAYQDIVHCIQVLRYYAGWADKNMGQNIPVDGDFFSFTKHEPVGICGLIIPWNYPMLMMTWKMAPALSCGNCIVVKPAEQTPLTALYCASLMEEAGFPPGVVNVVPGYGTICGQSISSHLDINKVSFTGSTEVGKLVMQAAGSSNLKRCSLELSGKCPVVVFPDTDLDFAVQQAHEAAFQNMGQCRWSGSRAYVHESIYEEFVKRSVEQATRRKIGDPYELDTEHGPQIDEEQYTKVLDYIKSAQEQGAKLKYGGNKHGDKGGYYIEPTVFSEVSDNMKIAKEEIFGPVQLLMKFRDLDDVIDRCNNSDYGMAAAIFTNDINRIMTFTNAVNTGTIWVNTFHHWFPQAPFGGFKTSGISREMGKYALREYTEVKSVIYRIPQKDS

SEQ ID NO: 24119 - protein, 495 aa, Ommastrephes sloani
MAGIPPPTRNPEIKHNKIFINNQFVNSTSNKAYPVYNPCDNEKVCEVQEGDKSDIDKAVQACKAAFKRGTPWRRMDASRLGHLLYRLADLMERDIAYMASLETMDTGKPYKNSYQDMVHCIQVLRYFAGWADKNMGESIPVDGDFFCYTRNEPVGVCGLLIPYNYPMLMMTWKMAPALACGNCMIVKPAEQTPLTALYCASLIKEAGFPPGVVNVVPGFGKICGQYISSHQEINKVSFTGSTEVGMLVMQDAGKSNLKRCSMQLSGKCPLVVFEDTELDFAVQQAHEAAFQNMGQCRWSGSRTYVHENIYDEFVKRAVEKATSRKTGDPYEMDTEHGPQIDEEQYKKIMEFIKKGKDKGAQLKCGGNRHGDKGFYVEPTVFSDVTDEMKFSQEEIFGPVQLIMKFKDMDEVIDRCNNTDYGMAAAIFTNDINRSITFTHAMYCGTVWVNTYNHWFPQAPFGGYKKSGLYREMGKYTLQEYTEVKNIVYRIPQKNS

SEQ ID NO: 24120 - protein, 261 aa, Buchnera aphidicola (Schizaphis graminum)
MCSLEELELWNMIKHKAQKILKKEPILSNFYQKSILNHKKLSHSLSCILSDKLSTSMISEKDIYNIFNKIYANNISIINSVVKDIKAASQRDPVVKHYLTPLLYLKGFHALEAYRLSHYLWNIKRYELSAYLQSRISTVFSVDIHPAASIGSGIMLDHATGIVIGEGVIIENDVSIFHSVTLGGTGSNTGKNRHPIIRKNVTIGAGAKILGNIEVGQGVKVGAGSIVLKNIPPFVTVVGVPAKIIKKIKNSNKNLFQKEKK

SEQ ID NO: 24121 - protein, 372 aa, Chlamydomonas reinhardtii [sequence omitted]

SEQ ID NO: 24122 - protein, 493 aa, Mus musculus
MGTTKVTPSLVFAVTVATIGSFQFGYNTGVINAPETILKDFLNYTLEERLEDLPSEGLLTALWSLCVAIFSVGGMIGSFSVGLFVNRFGRRNSMLLVNLLAIIAGCLMGFAKIAESVEMLILGRLLIGIFCGLCTGFVPMYIGEVSPTALRGAFGTLNQLGIVVGILVAQIFGLDFILGSEELWPGLLGLTIIPAILQSAALPFCPESPRFLLINKKEEDQATEILQRLWGTSDVVQEIQEMKDESVRMSQEKQVTVLELFRSPNYVQPLLISIVLQLSQQLSGINAVFYYSTGIFKDAGVQEPIYATIGAGVVNTIFTVVSLFLVERAGRRTLHMIGLGGMAVCSVFMTISLLLKDDYEAMSFVCIVAILIYVAFFEIGPGPIPWFIVAELFSQGPRPAAIAVAGCCNWTSNFLVGMLFPSAAAYLGAYVFIIFAAFLIFFLIFTFFKVPETKGRTFEDIARAFEGQAHSGKGPAGVELNSMQPVKETPGNA

SEQ ID NO: 24123 - protein, 488 aa, Acinetobacter calcoaceticus
MLTIVQEALTFDDVLLLPAYSTVLPKDVSLKTRLTRGIYLNIPLVSAAMDTVTESRMAIAMAQNGGIGILHKNMDIAAQAAEVRRVKKFEAGMVKDPITVSPETTVRELIAITSANNISGVPVVKDSKVVGIVTGRDTRFETNLEQPVSNIMTGQDRLVTVREGESKENIQALLQKHRIEKVLVVGESNELKGLITVTDFRKAESYPNSCKDDLGRLRVGAAVGTGADTPSRVEALVEAGVDVIVVDTAHGHSAGVIERVRWVKQNFPQVQVIGGNIATGDAALALLDAGADAVKVGIGPGSICTTRIVAGIGMPQISAIDSVASALKDQIPLIADGGIPFSGDMAKAIGAGASTIMVGSLLAGTEEAPGEVEFFQGRYYKAYRGMGSLGAMAGRTGSADRYFQDSKAGAEKLVPEGIEGRVPYKGPMGNIVHQMMGGLRSSMGYTGSAVIEDLRQNAKFVKITSAGMSESHVHDVTITKEAPNYRVG

SEQ ID NO: 24124 - protein, 501 aa, AKT8 murine leukemia virus
AREETLIIIPGLPLSLGATDTMNDVAIVKEGWLHKRGEYIKTWRPRYFLLKNDGTFIGYKERPQDVDQRESPLNNFSVAQCQLMKTERPRPNTFIIRCLQWTTVIERTFHVETPEEREEWATAIQTVADGLKRQEEETMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPTQRLGGGSEDAKEIMQHRFFANIVWQDVYEKKLSPPFKPQVTSETDTRYFDEEFTAQMITITPPDQDDSMECVDSERRPHFPQFSYSASGTA

SEQ ID NO: 24125 - protein, 337 aa, Dictyostelium discoideum
MNHSSKKNKNRILRNKARIYCDVNLHKPKEYWNYEALNVKWETQDDYEIIRKIGRGKYSEVFEGANIKNNEKCVIKVLKPVKKKKIKREIKILQNLCGGPNIITLYDVVRDPQSKTPSLIFEYINNTDFKHLSPTLTDFDVRYYIRELLHALDFCHSNGIMHRDVKPSNVMIDHQKRKLYLIDWGLAEFYHPNQDYNVRVASRPYKGPELLVDMEDYDYSLDMWSLGCMFAGMLFQKDPFFHGHDNIDQLVKIVKILGTEEFYAYLDKYGIVVDHTILSIIGKHPKKPWSRFITKENQHLAVPEAIDFLEKLLRYDPAERLTTREAMEHPYFKPLSH

SEQ ID NO: 24126 - protein, 510 aa, Plasmodium falciparum (isolate K1 / Thailand)
MEKRYQQLFKGKRIDFPLATGAASHVSLTYDEKKNPYLLCWTYIYQEKPEFTVPLKGCRIINNITEIGPCIHIITSNEEYQFQCRSKEEFDEMSQFFNMLGYPILGFKNVYVLNKKIGKGSFSTAYIGTNILYGNRVVVKEVDKSKVKESNVYTEIEVLRKVMHKYIIKLISAYEQEGFVYLVLEYLKGGELFEYLNNNGPYTEQVAKKAMKRVLIALEALHSNGVVHRDLKMENLMLENPNDPSSLKIIDFGLASFLNSPSMNMRCGSPGYVAPEILKCASYGTKVDIFSLGVILFNILCGYPPFRGNNVKEIFKKNMRCHISFNTKHWINKSESVKEIILWMCCKNPDDRCTALQALGHQWFLPKLTDMHMTANINELKRNEAIVHKSNDQQDMCKKCKHFNNTQNDDIYNNNNNNNQLDPNKNHKNNYNDYKNYFDTMLKIDDKYSENLIKDKTSMDSISLNKKDYDAYLVHSNEHDTVVLHGKCQTTKNSSSLLSYKCSRRSPPQN

SEQ ID NO: 24127 - protein, 548 aa, Phlebia radiata
MHTFLRSTALVVAGLSARALASIGPVTDFHIVNAAVSPDGFSRQAVLAEGVFPGPLIAGNKGDNFQINVIDELTNATMLKTTTIHWHGFFQHGTNWADGPAFINQCPIASGDSFLYNFQVPDQAGTFWYHSHLSTQYCDGLRGPFVVYDPADPYLDQYDVDDDSTVITLADWYHTAARLGSPFPAADTTLINGLGRCGEAGCPVSDLAVISVTKGKRYRFRLVSISCDSFFTFSIDGHSLNVIEVDATNHQPLTVDELTIYAGQRYSFILTADQDVDNYWIRANPGIGITTGFAGGINSAILRYDGADVVEPTTTQATSPVVLSESNLAPLTNAAAPGLPEVGGVDLALNFNLTFDGPSLKFQINGVTFVPPTVPVLLQILSGAQSAADLLPSGSVYALPSNATIELSLPAGALGGPHPFHLHGHTFSVVRPAGSTTYNYVNPVQRDVVSIGNTGDNVTIRFDTNNPGPWFLHCHIDWHLEAALPLSSLRTSLTLRPLTLSPRTGPTCALSTTLWTHLITSGFASIIQWMMGGNGLFAPHALSFLGSQ

SEQ ID NO: 24128 - protein, 249 aa, Carassius auratus
PEAASGVLEYAMKHFGELEIHATWYEKLHEWEDALVAYDKKIDMNKDDPELILGCMICLEALGEWGQLHQQCCEEWTLVSEETQAKMARMAAAAAWGLATGTVWKSILAWSQETPMMEPFTGQCLLYIRISSHWLNSALTKPETYWMLSSTAMAGESYSRAYGAMVSCQMLSELEEVIQYKLVPGRRDIIRETWWERLQGCQRIVEDWQRILMVRSLVISPHEDMRTWLKYASLCGKSGRIALAHKTLV

SEQ ID NO: 24129 - protein, 548 aa, Spermophilus tridecemlineatus
MDMGGLDNLIANTAYLQARKTDSDSRELQRRRRSLALPGPQGCAELRQSLSPHFHSLCEQQPIGRRLFRDFLATVPKYSQAVAFLEDVQNWELAEEGPAKTSTLQQLAATCARDPGPQSFLSQDLATKCRAASTDEERKTLVEQAKAETMSFLQEQPFQDFLASPFYDRFLQWKLFEMQPVSDKYFTEFRVLGKGGFGEVCAVQVRNTGKMYACKKLDKKRLKKKGGEKMALLEKEILEKVNSPFIVSLAYAFESKTHLCLVMSLMNGGDLKFHIYNVGTRGLAMSRVIFYTAQMTCGVLHLHGLGIVYRDLKPENVLLDDLGNCRLSDLGLAVEVQDDKPITQRAGTNGYMAPEILMDKASYSYPVDWFAMGCSIYEMVAGRTPFKDFKEKVSKEDLKERTMKDEVAFHHENFTEETKDICRLFLAKKPEQRLGSREKADDPRKHPFFQTVNFPRLEAGLVEPPFVPDPSVVYAKDVDEIDDFSEVRGVEFDDKDKQFFQRFSTGAVPVAWQEEIIETGLFEELNDPNRPSGDGKGDSSKSGVCLLL

SEQ ID NO: 24130 - protein, 420 aa, Gnetum gnemon
MDPESFSAAFFKWEQRSPIPLQMQRAGNVFHDFSVPSPTVGVPPIMANTSNVCISNRKEMICLEELFRHYGVRYITMTKMMEMGFTVNTLVNMTEQELDEAIRTLVEIYRMELLVGEKYGIKSAIRAERRRLDEAEKKRLQDLFSDVDGKRKIDENALDTLSQEGLSVEEPHGDNTMLLSQNNTASSFPLNLNAGTDPVLILQNGARMGSTVAAFMGLPADNNMGDSHGHGHGNNGNGKASKKQKRRRPRESGEEGEDRQREHPFIVTEPGELARGKKNGLDYLFDLYEQCGKFLSEVQQIAKERGEKCPTKVTNQVFRHAKYSGASYINKPKMRHYVHCYALHCLDVEQSNRLRKAYKERGENVGAWRQACYYPLVAKARENGWDIDGVFNKHEKLRIWYVPTKLRQLCHLEKSKQCHL

SEQ ID NO: 24131 - protein, 246 aa, Azospirillum brasilense
MSQKIALVTGAMGGLGTAICQALAKDGCIVAANCLPNFEPAAAWLGQQEALGFKFYVAEGDVSDFESCKAMVAKIEADLGPVDILVNNAGITRDKFFAKMDKAQWDAVIATNLSSLFNVTQQVSPKMAERGWGRIINISSVNGVKGQAGQTNYSAAKAGVIGFTKALAAELATKGVTVNAIAPGYIGTDMVMAIREDIRQAITDSVPMKRLGRPDEIGGAVSYLASEIAGYVTGSTLNINGGLNYQ

SEQ ID NO: 24132 - protein, 460 aa, Homo sapiens
MGRKEEDDCSSWKKQTTNIRKTFIFMEVLGSGAFSEVFLVKQRLTGKLFALKCIKKSPAFRDSSLENEIAVLKKIKHENIVTLEDIYESTTHYYLVMQLVSGGELFDRILERGVYTEKDASLVIQQVLSAVKYLHENGIVHRDLKPENLLYLTPEENSKIMITDFGLSKMEQNGIMSTACGTPGYVAPEVLAQKPYSKAVDCWSIGVITYILLCGYPPFYEETESKLFEKIKEGYYEFESPFWDDISESAKDFICHLLEKDPNERYTCEKALSHPWIDGNTALHRDIYPSVSLQIQKNFAKSKWRQAFNAAAVVHHMRKLHMNLHSPGVRPEVENRPPETQASETSRPSSPEITITEAPVLDHSVALPALTQLPCQHGRRPTAPGGRSLNCLVNGSLHISSSLVPMHQGSLAAGPCGCCSSCLNIGSKGKSSYCSEPTLLKKANKKQYVFLAKDGAPAWV

SEQ ID NO: 24133 - protein, 341 aa, Solanum chacoense
MAELLSNWSSTLEAVPPSHCIPVHERPSDPVEIVDSIPVIDLGKANGEERSAVVKDLLKAFEEYGFFQIINHGVPVDLMDEAMKVYKEFFSLPAEEKAEYAKDAANDTNRGAATLYSSSAKHYDSEEHRYWRDVLEHSCNLDGKDKKTWPSNPPRYREVIGAYGDELRRVSKVILGLLAEGLGLEAGFFDKELGQRMLVNHYPACPDPSLTLGVGGHCDPNLITIIQQEVYGLQILKDDKWIGVQPIRNAFVVNSGLPITVVSNGKLTSVAHRVVTNTTHSRTSIGTFICPHDIVEPAKALVGPENPPQFKSFNWGIDFMPHYLSKKSVYHASLEPFKIDA

SEQ ID NO: 24134 - protein, 502 aa, Secale cereale
MDGGGEHSEALKNYYLGKILGVGTFAKVIIAEHKHTRHKVAIKVLNRRQMRAPEMEEKAKREIKILRLFIDLIHPHIIRVYEVIVTPKDIFVVMEYCQNGDLLDYILEKRRLQEDEARRTFQQIISAVEYCHRNKVVHRDLKPENLLLDSKYNVKLADFGLSNVMHDGHFLKTSCGSLNYAAPEVISGKLYAGPEIDVWSCGVILYALLCGAVPFDDDNIPNLFKKIKGGTYILPIYLSDLVRDLISRMLIVDPMKRITIGEIRKHSWFQNRLPRYLAVPPPDMMQQAKMIDEDTLRDVVKLGYDKDHVCESLCNRLQNEETVAYYLLLDNRFRATSGYLGAHYQQPMESASPSTRSYLPGSNDSQGSGLRPYYRVERKWALGLQQSRAPPRAIMIEVLKALKELNVCWKKNGDCYNMKCRWCPGFPRVSDMLLDANHSFVDDCAIKDNGDANSRLPAVIKFEIQLYKTKDDKYLLDMQRVTGPQLLFLEFCAAFLTNLRVL

SEQ ID NO: 24135 - protein, 296 aa, Stigmatella aurantiaca
MQISNDPSSHSGSLTMYLSEINQYGLLSVEEEQALARKFVKGDLAAGHRLVTSNLRFVVKVSYEYRSYGIKMSDLIQEGNIGLMKAVQKFDPDKGIRLISYAVWWIRAYIQNYILKSWSLVKLGTTQAQRKLFFSLARTRRELEKFGAGDGAVVNVDEIANKLNVKASEVREMEQRMGGRDLSLDAPMGEDGGNSHVDFVASAAAPQDDEFADKEEAGLINSRVHMALMRLDPRERFIIEQRVMNERPMTLKELGEHFGFSRERARQLEIRAKDKLKAELAALLAEVDPDAAAALQ

SEQ ID NO: 24136 - protein, 1068 aa, Zea mays; identical to SEQ ID NO: 6664

SEQ ID NO: 24137 - protein, 1056 aa, Spinacia oleracea
MAGNDWINSYLEAILDVGGQGIDASTGKTSTAPPSLLLRERGHFSPSRYFVEEVISGFDETDLHRSWVRAASTRSPQERNTRLENLCWRIWNLARKKKQIEGEEAQRLAKRHVERERGRREATADMSEDLSEGERGDTVADMLFASESTKGRMRRISSVEMMDNWANTFKEKKLYVVLISLHGLIRGENMELGRDSDTGGQVKYVVELARALGSMPGVYRVDLLTRQVSAPGVDWSYGEPTEMLSSRNSENSTEQLGESSGAYIIRIPFGPKDKYVAKELLWPYIPEFVDGALSHIKQMSKVLGEQIGGGLPVWPASVHGHYADAGDSAALLSGALNVPMVFTGHSLGRDKLDQLLKQGRLSREEVDATYKIMRRIEAEELCLDASEIVITSTRQEIEEQWQLYHGFDLVLERKLRARMRRGVSCHGRFMPRMAKIPPGMEFNHIAPEDADMDTDIDGHKESNANPDPVIWSEIMRFFSNGRKPMILALARPDPKKNLTTLVKAFGECRPLRELANLTLIIGNRDDIDEMSTTSSSVLISILKLIDKYDLYGQVAYPKHHKQSDVPDIYRLAAKTKGVFINPAFIEPFGLTLIEAAAYGLPIVATKNGGPVDIIGVLDNGLLIDPHDQKSIADALLKLVADKHLWTKCRQNGLKNIHLFSWPEHCKNYLSRIASCKPRQPNWQRIDEGSENSDTDSAGDSLRDIQDISLNLKLSLDAERTEGGNSFDDSLDSEEANAKRKIENAVAKLSKSMDKAQVDVGNLKFPAIRRRKCIFVIALDCDVTSDLLQVIKTVISIVGEQRPTGSIGFILSTSMTLSEVDSLLDSGGLRPADFDAFICNSGSELYYPSTDYSESPFVLDQDYYSHIDYRWGGEGLWKTLVKWAASVNEKKGENAPNIVIADETSSTTHCYAFKVNDFTLAPPAKELRKMMRIQALRCHAIYCQNGTRLNVIPVLASRSQALRYLFMRWGVELSNFVVFVGESGDTDYEGLLGGVHKTVILKGIGSNTSNFHATRAYPMEHVMPVDSPNMFQTGGCNIDDISDALSKIGCLKAQKSL

SEQ ID NO: 24138 - protein, 807 aa, Hordeum vulgare
MAAKLTRLHSLRERLGATFSSHPNELIALFSRYVHQGKGMLQRHQLLAEFDALFESDKEKYAPFEDILRAAQEAIVLPPWVALAIRPRTGVWDYIRVNVSELAVEELTVSEYLAFKEQLVDEHASRKFVLELDFEPFNASFPRPSMSKSYGKGVQFLNRHLSSKLFQDKESLYPLLNFLKAHNYKGTTMILNDRIQSLRGLQSALRKAEEYLVSIPEDTPSSEFNHRFQELGLEKGWGDTAKRVHDTIHLLLDLLEAPDPASLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDILRVPFRTENGIRKWISRFDVWPYLETYTEDVANELMREMQTKPDLIIGNYSDGNLVATLLAHKLGVTQCTIAHALEKTKYPNSDIYLDKFDSQYHFSCQFTADLIAMNHTDFIITSTFQEIAGSKDSVGQYESHIAFTLPDLYRVVHGIDVFDPKFNIVSPGADMTVYFPYTETDKRLTAFHSEIEELLYSDVENDEHKFVLKDRNKPIIFSMARLDRVKNMTGLVEMYGKNAHLKDLANLVIVAGDHGKESKDREEQAEFKRMYSLIEEYKLKGHIRWISAQMNRVRNGELYRYICDTKGAFVQPAFYEAFGLTVIEAMTCGLPTIATCHGGPAEIIVDGVSGLHIDPYHSDKAADILVNFFEKSTADPSYWDKISQGGLKRIYEKYTWKLYSERLMTLTGVYGFWKYVSNLERRETRRYLEMFYALKYRSLAAAVPLAVDGESSGN

SEQ ID NO: 24139 - protein, 816 aa, Hordeum vulgare
MGETAGERALSRVHSVRERIGHSLSAHTNELVAVFSRLVNQGKGMLQPHQITAEYNAAIPEAEREKLKNTPFEDLLRGAQEAIVIPPWVALAIRPRPGVWEYVRVNVSELGVEELSVLRYLQFKEQLANGSTDNNFVLELDFGPFNASFPRPSLSKSIGNGVQFLNRHLSSKLFHDKESMYPLLNFLRAHNYKGMTMMLNDRIRSLGTLQGALRKAETHLSGLPADTPYTEFHHRFQELGLEKGWGDCAQRASETIHLLLDLLEAPDPSSLEKFLGTIPMVLNVVILSPHGYFAQANVLGYPDTGGQVVYILDQVRAMENEMLLRIKQQGLDITPKILIVTRMLPDAHGTTCGQRLEKVLGTEHTHILRVPFKTEDGIVRKWISRFEVWPYLEAYTDDVAHEIAGELQANPDLIIGNYSDGNLVACLLAHKLGVTHCTIAHALEKTKYPNSDLYWKKFEDHYHFSCQFTADLIAMNHADFIITSTFQEIAGNKDTVGQYESHMAFTMPGLYRVVHGIDVFDPKFNIVSPGADMSIYFPYTEQQKRLTSLHTEIEELLFSDVENAEHKFVLKDKKKPIIFSMARLDRVKNMTGLVEMYGRNPRLQELVNLVVVCGDHGKVSKDKEEQVEFKKMFDLIEKYNLSGHIRWISAQMNRVRNGELYRYICDMKGAFVQPAFYEAFGLTVIEAMTCGLPTFATAYGGPAEIIVNGVSGYHIDPYQNDKASALLVGFFGKCQEDPSHWNKISQGGLQRIEEKYTWKLYSERLMTLSGVYGFWKYVSNLDRRETRRYLEMLYALKYRKMAATVPLAVEGETSGE

SEQ ID NO: 24140 - protein, 816 aa, Oryza sativa; identical to SEQ ID NO: 3175

SEQ ID NO: 24141 - protein, 806 aa, Vicia faba
MATERLTRVHSLRERLDETLTANRNEILALLSRIEAKGKGILQHHQVIAEFEEIPEENRQKLTDGAFGEVLRSTQEAIVLPPWVALAVRPRPGVWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLSTVDPETPYSEFEHRFQEIGLERGWGDSAERVLESIQLLLDLLEAPDPCTLETFLDRIPMVFNVVILSPHGYFAQDDVLGYPDTGGQVVYILDQVRALESEMLNRIKKQGLDIVPRILIITRLLPDAVGTTCGQRLEKVYGTEHCHILRVPFRDQKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADQTIYFPYTETSRRLTSFYPEIEELLYSTVENEEHICVLKDRSKPIIFTMARLDRVKNITGLVEWYGKNAKLRELVNLVVVAGDRRKESKDLEEKAEMKKMYELIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKADPSHWDKISLGGLQRIEEKYTWQIYSQRLLTLTGVYGFWKHVSNLDRLESRRYLEMFYALKYRKLAESVPLAVEE

SEQ ID NO: 24142 - protein, 420 aa, Pseudomonas syringae pv. tabaci
MPISESFARRLFPLLDELTNTYPTPFHIYDERAIVQTHRNVAQAFADSAFRQYFAVKALPTPAILSLLLKEGSGLDCSSPVELMLAERLGARGDDIVFTSNNTSLSEYQMALQAGALVTFDDRSMLEQVIALPDIVAFRVSPHGVIARSSQMGNAQQSKFGIPEAELVQSYREAWDRGARRFGIHGMMCANELSLEAAVQAGVQVIEVGARVAREAGIELEYINIGGGLGIPYRIDDQALDLTAYADALKRALKQAFPHNTPKLLMELGRYISGPHGVLVSRVINRCSKGREIVGLDASMSALMRPGLYGAYHHLTLPFADQRPEGVFDVVGALCENFDKFAVDRLLPSPLIGDLALIHDTGAHGHAMGFTYNGRLRPAELMLTDDGDVVEIRRAETFDDHTGPIQWQPVDVFNPTRCVK

SEQ ID NO: 24143 - protein, 318 aa, Pichia stipitis
MPSIKLNSGYDMPAVGFGCWKVDVDTCSEQIYRAIKTGYRLFDGAEDYANEKLVGAGVKKAIDEGIVKREDLFLTSKLWNNYHHPDNVEKALNRTLSDLQVDYVDLFLIHFPVTFKFVPLEEKYPPGFYCGKGDNFDYEDVPILETWKALEKLVKAGKIRSIGVSNFPGALLLDLLRGATIKPSVLQVEHHPYLQQPRLIEFAQSRGIAVTAYSSFGPQSFVELNQGRALNTSPLFENETIKAIAAKHGKSPAQVLLRWSSQRGIAIIPKSNTVPRLLENKDVNSFDLDEQDFADIAKLDINLRFNDPWDWDKIPIFV

SEQ ID NO: 24144 - protein, 1430 aa, Artemia salina
MKNCVLILVGLAAIASAAEVRGILCSDKATIKRTWSIVNDLPSFGRNVFLSVFAAKPEYKNLFVEFRNIPASELANSERLLYHGGRVLASIDEVISEIDSPDSAAKKLVALGERHITRGTVRRHFEAFSYAFIDELKQRGVASADLAAWRKGWDSIVDILEAGLLKRQIDLEVTGLSCVDVANVQESWATVSANLKNTGSILFQRLINDHPEYQQLFRQFRDVELAKLGESNGFVAHVFRVVAAFDGIIKELDNNPFIVSTLKRLGEQHIARGTDISHFQNFRTTLLVYLNENGMNQAQEASWNKAFDAIEKYISIGLKSLGRVDPITGLSGLEKNAILNTWGKVRGNLQEVGKATFGKLFAAHPEYQQMFRFFQGVQLAELVDSPKFAAHTQRVVSALDQTLLALNRPSDFVYMIKELGLDHINRGTDRSHFENYQVVFVEYLKETLGDSVDEFTVKSFNHVFEVIINFLNEGLRQANVVDPVTHLTGRQKEAIKASWSVARTDLRFLGQELFMRMFNLNPEYQSLFVNKGFADVPLVSLREDERFISHMANVLRGFDTLLQNLDDTSYFVYALRNLGDAHIQRKAGTEHFRSFEAILIPYLQESQGLDAAGVEAWKIFFDVSIGVIAQGLKVASSEEADPVTGLYGKEVVALRQAFAAISPRNVEIGKRVFAKLFTSHPEYKNLFKKFEQYSVEELPSTDAFDYHISLVMNRFSAVGKVIDDNVSFVYLLKKLGREHIKRGLSRKQFDQFVELYIAEISPELSETGRSGLEKVLTFATGVIEQGLFQLGQVDSKALTALEKQSIQDIWTSLRPTGLEELAVKMFTRLFADHPEYKLLFTGRLGNVDNINENAPFRAHLHRVLSAFDIVITSLDNNALLIRQLKDLGLFHTRLGMTRAHFDNFATAFFSVAEDIVPNLLTALGRESLGKGFKLMVAVIEEGLLQLERIDPITGLSVREVEVVKQTWNLVKPDLMGVGMRIFKSLFEKFPAYQAVFPKFSDVPLDKLEDIPAVGKHAISVTTKLDELIQTLDEPANLALLARQLGEDHIVLGVNKPMFKSFGEVLVRLLENDLGQRFSNFASKSWHRAYDVIVEYIEEGLQQSYKQDPVTGITDAEKVLVQRSWELLKPDLLGLGRKIFGVIFTKHPEYQILFTRVGFGDTPLTQLDNNPAFGEHIIKVMRAFDYVIRNLGKPKTLLAYLKNVGADHIARNVERRHFQAFSEALIPVMQRELKAQLKPEAVAAWRKGLDRIIGVIDQGLLGLKEVNPQIAFSAADIEAIQKTWALAKPDLMGKGASVFRQLFTDHGYQPLFSNLVEYEVTGLEGSPELNTHARNVMAQLDTLVGSLQNSIELGKSLNQLGKDHVPRKVNKVHFDDFAEHFVPLMKANLGDEFTPLAESAWKKAFNVMVATIEQGQRARRSIATFLTNPVA

SEQ ID NO: 24145 - protein, 541 aa, Pichia angusta
MKLSMSVLALVATCIGSAQAAAIKKDTAGQHPLGMNSKFGDVFVEKGKSLLDRVSEVVSESSKNISPELRDIWNEMEAKFPDTLKNMKLKSEPVVKITKKPADFWDFNVFNEKFSNYKLRVKKTDPGALGLDHTRQYSGYLDVEDEDKHFFYWMFESRNDPANDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKIGAEVETYESCNFDVNRNFLFAGDWMKPYHKNVINLLEQGLPVLIYAGDKDFICNWLGNQAWSNELPWSGHEEFESAELYNLTLKDGTKVGEVKNAGKFTFARMFDGGHMVPYDQPESSLAMVNRWIAGDYSLGTKK

SEQ ID NO: 24146 - protein, 942 aa, Dictyostelium discoideum
MSWLNNPSQNFVDPFIRIKCILGDDIRIIKFNSNISYGGLMNQLEQDFQCPISIHQYEDYEGDKVTVKSKDDIMEALTMYFELKALNPTKIISTKFFLKQLPPQSQPLSSSLSPTQSLILNNNNNNNNNNNNNNNNNNNNNNNNIIQHTDFPSLIINEHEELISNHNIKWQKGQILGRGGYGSVYLGLNKDTGELFAVKQLEIVDINSDPKLKNMILSFSKEIEVMRSLRHDNIVRYLGTSLDQSFLSVFLEYIPGGSISSLLGKFGAFSENVIKVYTKQILQGLSFLHANSIIHRDIKGANILIDTKGIVKLSDFGCSKSFSGIVSQFKSMQGTPYWMAPEVIKQTGHGRSSDIWSLGCVIVEMATAQPPWSNITELAAVMYHIASSNSIPNIPSHMSQEAFDFLNLCFKRDPKERPDANQLLKHPFIMNLDDNIQLPTISPTTTLSTNTTNTTATTTTTNNATNSNINQQQQQQQQQPPTRTQRVSISAGSSNNKRYTPPISTSTSSSSSSILNNFSINIILPINLIILIFREIKPNFVNTLSRVCKHWKQIIDDDELWNKYCSDRLINKSKFEESITWKSNYIKIYKQQKVWFHNKLNHSTLKGHDKGVFCVKLIDDQGMVLSGGEDKKLKVWDISGNHHHNHHSGIVGSISKKSGLNIINNNNSNNSNSSSNSSSSNSRYLFSLKGHSGCIKSVDYQRQSGSDVSRVFTASADFTCKIFSLKTKKTLFTYTNHQEAVTCINYLGDVENKCITSSLDKTIQLWDAETGSCLSTLRGHTGGIYCVKTDQVATHGNGYNHLVVSASVDKTSNVWDTRSSSKVRSFTQHTEDVLCCYVFDQKVVTGSCDGTIKLWDIGTGKTISTFIPSETRQKNYVWTVQFDQSKIISSGKTGIIRIWDIYNERDSRSIGGHHETIFSLQFNNQKLITGSLDKLVKIWSID

SEQ ID NO: 24147 - protein, 340 aa, Lactococcus lactis
MDELSVKFGIVDDALEDLFKQIQDAGISIVDKDGNPSPLALVTDEIEKEEVSDTAMDEIVTNVRIDDPVRMYLKEIGRYPLISLDEETKLAEAIIAGGEGAEFAKQMLAEANLRLVVSIAKRYSGRGMQFLDLIQEGNMGLMKAVDKFDQTKGFKFSTYATWWIRQAITRAIADQARTIRIPVHMVETINKLIRVQRNLLQELGRDPSPEEIGKELHMAPDKVREVLKIAQEPVSLETPIGEEDDSHLGDFIEDDVIESPVDYTNRILLREQLDEVMDTLTDREENVLRMRFGLDDGRMHTLEDVGKQFKVTRERIRQIEAKAIKKLRHPRRSKPLRDFM

SEQ ID NO: 24148 - protein, 449 aa, Agrobacterium vitis
MQAQEVRLLYLFREDGVVTNDLEARVLRKITFRIVPFIMLLYFIAFLDRVNIGFAALTMNQDLGFSSTVFGIGAGIFFVGYFLFEVPSNLILNKVGARIWIARVMITWGIVSGLMAFVQGTTSFYILRFLLGVAEAGFFPGIILYLSFWFPARRRAAVTALFMAAAPLSTVLGSPISGALMEMHGLMGLAGWQWMFLIEAAPALILGVVVLFFLTDRPEKAKWLTEEERNWLVKTMNAEQAGRGTASHSVMAGLADIRVIALALVYFGTSAGLYTLGIWAPQIIKQFGLSAIEVGFINAVPGIFAVVAMVLWARHSDRTGERTWHVVGACLLAAAGLAFAAGATSVFMVLIALTIVNVGISCSKPPLWSMPTMFLSGPAAAAGIATINSIGNLGGFVGPSMIGWIKDTTGSFTGGLYFVAGLLLISAILTLILARSSPKAVETRTANQH

SEQ ID NO: 24149 - protein, 433 aa, Agrobacterium vitis
MNSDLETRVLRKITLRIVPFIMLLYFVAFLDRVNIGFAALTMNEDLGFSSTVFGIGAGIFFVGYFLFEVPSNLILNKVGARIWIARVMITWGIVSGLMAFVQGTTSFYALRFLLGVAEAGFFPGIILYLSFWFPARRRAAVTAIFMAAAPLSTVLGSPISGALMEMHGFLGLAGWQWMFLIEAAPAVILGVVVLFYLTDRPEKAKWLSEDERNWLVKTMNAEQAAKGKASHSILAGLADIRVIALALVYFGTSAGLYTLGIWAPQIIKEFGLSSLQVGFINAVPGIFAVAAMVLWARHSDKTGERTWHVVGACLLAAVGLAFATGATSVFTVLIALTLVNIGISCSKPPLWSMPTLFLSGPAAAAGIATINSIGNLGGFVGPSMIGWIKDTTGSFAGGLYFVAGLLVVSAIVTLVLSRTAPENGGKVAPVQHR

SEQ ID NO: 24150 - protein, 575 aa, Drosophila melanogaster
MAPTKATTRAAITSGHHQLQQAVNPILGALGAATRKGLTRRAAATGNIDPNVENMQTRAKRKADHSPIKNDKIKRSALGNLTNNVKIMTLHPAQDEEQSGVGKKPTAQQLQALMDAKKQENLSVNVFGASKMTTRASSKVEDSVENCHKVLDKLEEALARPKPRPKAVPAAKKTVLGEVQLPAMPNPMQIPVLLPPTHNLAAPQVAAVKPVRRISNDFNKTEDSLYMSALEDVSSCDSMRLPGNFEAARRRSAKLQQKTEQQPQPLLLTLPETAPSQVVPIPPVPEEVEDFDRKNWDDPFQVSHYAMDIFNYLKVREAEFPIADYMPRQIHLTTWMRTLLVDWMVEVQETFELNHETLYLAVKIVDLYLCREVINKEKLQLLGAAAFFIACKYDERQPPLIEDFLYICDGAYNHDELVRMERETLRVIKYDLGIPLSYRFLRRYARCAKVPMPTLTLARYILELSLMDYANISFSDSQMASAALFMALRMHGGPGQLDKQTWTSTLIYYTGYQLADFAEIVTALNAGLHRKPRATIKTIRNKYSHKIFHEVAKVPLLTNQELFQGNLDLNESNLS

SEQ ID NO: 24151 - protein, 575 aa, Drosophila melanogaster
MAPTKATTRAAITSGHHQLQQAVNPILGALGAATRKGLTRRAAATGNIDPNVENMQTRAKRKADHSPIKNDKIKRSALGNLTNNVKIMTLHPAQDEEQSGVGKKPTAQQLQALMDAKKQENLSVNVFGASKMTTRASSKVEDSVENCHKVLDKLEEALARPKPRPKAVPAAKKTVLGEVQLPAMPNPMQIPVLLPPTHNLAAPQVAAVKPVRRISNDFNKTEDSLYMSALEDVSSCDSMRLSGNFEAARRRSAKLQQKTEQQPQPLLLTLPETAPSQVVPIPPVPEEVEDFDRKNWDDPFQVSHYAMDIFNYLKVREAEFPIADYMPRQIHLTTWMRTLLVDWMVEVQETFELNHETLYLAVKIVDLYLCREVINKEKLQLLGAAAFFIACKYDERQPPLIEDFLYICDGAYNHDELVRMERETLRVIKYDLGIPLSYRFLRRYARCAKVPMPTLTLARYILELSLMDYANISFSDSQMASAALFMALRMHGGPGQLDKQTWTSTLIYYTGYQLADFAEIVTALNAGLHRKPRATIKTIRNKYSHKIFHEVAKVPLLTNQELFQSNLDLNESNLS

SEQ ID NO: 24152 - protein, 825 aa, Gallus gallus
MEQPEVPGSTADTGGSGSTAPPGTESSTAQPAPTAATNAVQAQNRGKEEPMEKTVGAAGEPHGGTAETAQEKVPTAAGKEEPGKEVAPGAAAEAQGAEREKAVPEGGKAEPEQEKVPNAAPHWDGGEKGAAKDGASAAETNRGKEEPAKEKAPTGESRGETAEPTRGKGSAAAGAQEEPPKESAPGAPGAEAGGEAEPAKKASAAAEAERGKAEPAGSVPAAAPAHGEGEPVKEQPAAVKAEDGGKNAAKAKKSSAAKQPAKEKAPAAAKDGGKKPTKVEKIAAVTKDGGKETAKEKAMAPAKEKATVAAQKPPAAVKAEDGGREPTEKAPAAAGAQGEGEKEASAEQTNKEQPPRGSEPTRPTLMQSLSCPATCQREEQPRQEVAAMETIPEETPPMAPAGEEPTPAQGDLQPPEQPIPAGSTAVPQERTLPGAEEQPQVGSEPPGHAEQPGPGATGQPAATVAEPPPSPYLTPDFGKEDPFEILDDVPPPPAPFAHRIITLRTGSVSSQYNLSSKEILGGGKFGEVHTCTEKQTGLKLAAKVIRKQGAKDKEMVLLEIDVMNQLNHRNLIQLYDAIETPREIILFMEFVEGGELFERIIDDDYHLTEVDCMVFVRQICEGIRFMHHMRVLHLDLKPENILCVAATGHMVKIIDFGLARRYNPEEKLKVNFGTPEFLSPEVVNYEQVSYSTDMWSMGVITYMLLSGLSPFLGDNDTETLNNVLAANWYFDEETFESVSDEAKDFVSNLIIKEKSARMSAGQCLQHPWLTNLAEKAKRCNRRLKSQVMLKKYVMRRRWKKNFIGVCAANRFKKITSSGSLTALGV

SEQ ID NO: 24153 - protein, 341 aa, Glycine max
MSSTAGQVIKCKAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNG

SEQ ID NO: 24154 - protein, 760 aa, Drosophila melanogaster
MNSTKVPPEWKRRVKSEYIKIRQQKRYKRADEIKEAWIRNWDEHNHNVQDLYCESKVWQAKPYDPPHVDCVKRAEVTSYNGIPSGPQKVPICVINAVTPIPTMYTWAPTQQNFMVEDETVLHNIPYMGDEVLDKDGKFIEELIKNYDGKVHGDKDPSFMDDAIFVELVHALMRSYSKELEEAAPSTSTAIKTEPLAKSKQGEDDGVVDVDADCESPMKLEKTESKGDLTDVEKKETEEPVETEDADVKPAVEEVKDKLPFPAPIIFQAISANFPDKGTAQELKEKYIELTEHQDPERPQECTPNIDGIKAESVSRERTMHSFHTLFCRRCFKYDCFLHRLQGHAGPNLQKRRYPELKPFAEPCSNSCYMLIDGMKEKLAADSKTPPIDSCNEASSEDSNDSNSQFSNKDFNHENSKDNGLTVNSAAVAEINSIMAGMMNITSTQCVWTGADQALYRVLHKVYLKNYCAIAHNMLTKTCRQVYEFAQKEDAEFSFEDLRQDFTPPRKKKKKQRLWSLHCRKIQLKKDSSSNHVYNYTPCDHPGHPCDMNCSCIQTQNFCEKFCNCSSDCQNRFPGCRCKAQCNTKQCPCYLAVRECDPDLCQACGADQFKLTKITCKNVCVQRGLHKHLLMAPSDIAGWGIFLKEGAQKNEFISEYCGEIISQDEADRRGKVYDKYMCSFLFNLNNDFVVDATRKGNKIRFANHSINPNCYAKVMMVTGDHRIGIFAKRAIQPGEELFFDYRYGPTEQLKFVGIEREMEIV

SEQ ID NO: 24155 - protein, 433 aa, Cucumis melo
LEEGKKEPFHYDEEINLLLSDWWHESVLKQEVGLSSSPMRWIGEPQSILINGRGQSNCSIGAKYMKNMEQCKLSGSEECAPFILFVKPNKTYRIRIISTTSLSALNFAIGNHKLLVVEADGNYVQPFLTSDIDIYSGESYSVLINTDQNPSQNYWVSLGVRGREPKTPPGLTLLNYLPNSFSKLPISPPPETPKWNDYDRSKNFTYRILAAMGSPKPPVKSTRRIFLLNTQNKMNGGYTKWAINNVSLTLPSTPYLGAIKIGINDTFDQNPPPETYPENYDIHKPPPNGNTITGNGVYRFQLGEIVDVVLQNANTLNDKHSEIHPWHLHGHDFWVLGYGEGKFSAAVDETKLNLKDPPLRNTVVIFPFGWTVLRFVADNPGVWAFHCHIEPHLHMGMGVVFAEGVDKVGRIPTHAMACGGTAKALIQNPTQKP

SEQ ID NO: 24156 - protein, 687 aa, Cucumis melo
MAKVANQPLFPLPFLVFFVLSIIFGFGITLSKAVSQTRYYKFEVDYMFWSPDCVENIVLGINGTFPGPPIRANVNDTVVVEVINNLSTEGVVIHWHGILQRGTPWADGTASISQCPINPGENFTYEFKVDKPGTYFYHGHFGMQRAAGLYGSLIVDLEEGKKEPFQYDEEINLLLSDWWHTSIQEQEVGLKSNPMRWIGELQVILINGTGQFNCTSLDKYNTSSEHCEWKDQCAPFVLKVEPNKTYRIRIASTTSLSALNFAIANHTMLVVEADGNYVDPFETSDIDIYSGESYSVLVTTNQATTQNYWASIGVRGRKPKTSPALLLFNYLPNSVAKLPISPPPETPKWDDYDRSKSFTNRVLASAMNTTKPPPIFTRRISLLNTQNRINGKFTKWAINNISLTLPSTPYLGAIKFGLNSTFNQTPPPETFPKNYNIKIPPPNPNTNTGNGVYRFRSGEIVDVILQNANALTNNTSEIHPWHLHGHDFWVLGFGDFKFSAADETKLNLKNPPLKNTVVIFPFGWTAIRFVADNPGVWIFHCHIEPHLDMGMGVIFAEAVERVREIPPYALACGRTATHNVVPIIPQPKPPRGPGPVIPYFMLWVIGLVIIVCGIGLFGVCLYRIGLRRGYTFNNLSWRPYLGLSDSQSNQIEFSDLSRSNLTQEESNPTQEESNPTQEESNPILEEP

SEQ ID NO: 24157 - protein, 457 aa, Thermococcus hydrothermalis
MARKVLVALLVFLVVLSVSAVPAKAETLENGGVIMQAFYWDVPGGGIWWDTIAQKIPDWASAGISAIWIPPASKGMSGGYSMGYDPYDFFDLGEYYQKGSVETRFGSKEELVNMINTAHAHNMKVIADIVINHRAGGDLEWNPFTNSYTWTDFSKVASGKYTANYLDFHPNELHAGDSGTFGGYPDICHDKSWDQHWLWASNESYAAYLRSIGIDAWRFDYVKGYAPWVVKNWLNRWGGWAVGEYWDTNVDALLSWAYDSGAKVFDFPLYYKMDEAFDNNNIPALVDALKNGGTVVSRDPFKAVTFVANHDTNIIWNKYPAYAFILTYEGQPAIFYRDYEEWLNKDRLRNLIWIHDHLAGGSTDIIYYDSDELIFVRNGYGDKPGLITYINLGSSKAGRWVYVPKFAGSCIHEYTGNLGGWIDKWVDSSGRVYLEAPAHDPANGQYGYSVWSYCGVG

SEQ ID NO: 24158 - protein, 226 aa, Drosophila melanogaster
MSAVAYDSLLSTTAVISTVFQFLSGAMICRKYIQKKSTGDSSGVPFICGFLSCSFWLRYGVLTNEQSIVLVNIIGSTLFLVYTLIYYVFTVNKRACVKQFGVCSDCSGGGHCLHQSAGRSARSNDTRHRNCVLHRDRVFFAAPLASLLHVIRAKNSESLPLPLIATSFVVSLQWLIYGILISDSFIQIPNFLGCILSLLQLGLFVLYPPRSYSGHGYKLVEQAVPF

SEQ ID NO: 24159 - protein, 332 aa, Rattus norvegicus
MPGAVEGPRWKQAEDIRDIYDFRDVLGTGAFSEVILAEDKRTQKLVAIKCIAKKALEGKEGSMENEIAVLHKIKHPNIVALDDIYESGGHLYLIMQLVSGGELFDRIVEKGGYTERDRSRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNRTAVVRHMRKLQLGHQPGGTGTDS

SEQ ID NO: 24160 - protein, 548 aa, Escherichia coli K12
MGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGQRLQLRQQQQQLSQQIVAAADEIARLAQGQANNATTSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALYQQDSEISNHLQTLAQNNIAQFAQFSSEVSQLVDTIELRNQHGLAHLEKASARGQYSLLLLGMVSLCALILILWRVVYRSVTRPLAEQTQALQRLLDGDIDSPFPETAGVRELDTIGRLMDAFRSNVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATAIADDMPCALMGD

SEQ ID NO: 24161 - protein, 258 aa, Corynebacterium glutamicum
MSKVAMVTGGAQGIGRGISEKLAADGFDIAVADLPQQEEQAAETIKLIEAADQKAVFVGLDVTDKANFDSAIDEAAEKLGGFDVLVNNAGIAQIKPLLEVTEEDLKQIYSVNVFSVFFGIQAASRKFDELGVKGKIINAASIAAIQGFPILSAYSTTKFAVRGLTQAAAQELAPKGHTVNAYAPGIVGTGMWEQIDAELSKINGKPIGENFKEYSSSIALGRPSVPEDVAGLVSFLASENSNYVTGQVMLVDGGMLYN

SEQ ID NO: 24162 - protein, 422 aa, Sphingomonas paucimobilis
MLSAEQNDKLARVGPGTPMGELLRRYWHPIGGESEFETKATRPVRLMGEDLVLYKDLSGNYGLMDRHCPHRRADMACGMVEADGLRCSYHGWMFDAQGACTEQPFEDTANPKGRYKDKVRIKAYPVRAWGAFSGPIWAPPRAQTADWAPFSWKNGFRQIVISVLPCNWLQGQENSMDPIHFEWMHANWSKRLRGETGPYGPKHLKIDFREYDYGFTYNRIREDTDETNPLWTIGRACLWPNAMFTGDHFEYRVPIDDETMMSVGWFFTPCRAMPSPMCRSPSPSGMARSRTRKASGSPAMMNQDFVAWIGQGNISDRTQENLGLSDKGIGMMRRQFLRDMEKISRGEDPKAIIRHPAINKAIPLPTIHRDAVMEGMTAEEIEAGGALHLKRFIFQYGQPEHVLKMQQDAMRISQDNKGYVDA

SEQ ID NO: 24163 - protein, 1022 aa, Rattus norvegicus
MAKPYEFNWQKEVPSFLQEGAVFDRYEEESFVFEPNCLFKVDEFGFFLTWKSEGKEGQVLECSLINSIRLAAIPKDPKILAALESVGKSENDLEGRILCVCSGTDLVNIGFTYMVAENPEITKQWVEGLRSIIHNFRANNVSPMTCLKKHWMKLAFLTNTSGKIPVRSITRTFASGKTEKVIFQALKELGLPSGKNDEIEPAAFTYEKFYELTQKICPRTDIEDLFKKINGDKTDYLTVDQLVSFLNEHQRDPRMNEILFPFYDAKRAMQIIEMYEPDEELKKKGLISSDGFCRYLMSDENAPVFLDALELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQEYQMSKYCEDLFGDLLLKQALESHPLEPGRLLPSPNDLKRKILIKNKRLKPEVKKKQLEALKSMMEAGESAAPASILEDDNEEEIESADQEEEAHPEYKFGNELSADDFSHKEAVANSVKKGLVTVEDDEAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTLRKEFRTHMVMNNGLNPVYNEESFVFRKVIMPDLAVLRIAVYNDNNKLIGQRILPLDGLQAGYRHISLRNEGNKPLSLPTIFCNIVLKTYVPDGFGDIVDALSDPKKFLYITEKRADQLRAMGIETSDIADVPSDTSKNDKKGKANPAKANVTPQSSSELRPTTTAALGSGQEAKKGIELIPTVRIEDLKQMKAYLKHLKKQQKELNSLKKKHAKEHSTMQKLHCTQVDKIVAQYDKEKSTHEKILEKAMKKKGGSNCLEIKKETEIKIQTLTSDHKSKGKQRDASPSG

SEQ ID NO: 24164 - protein, 478 aa, Gallus gallus
MATITCNRFTEEYQLFEELGKGAFSIVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHHNGVVHRDLKPENLLLASKLKGAAVKLADFGLAIEVEGDQQAWFGFAGTPGYLSPEVLRKDPYGKAVDLWACGVILYILLVGYPPFWDEDQHRLYQQIKAGAYDFPSPEWDTVTPEAKDLINKMLTINPSKRITAAEALKHPWISHRATVASCMHRQETVDCLKKFNARRKLKGAILTTMLATRNFSGGKSGGNKKNDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYVDVGGIPRTAQSEETRIWHRRDGKWQIVHFHRSGAPSVLPQ

SEQ ID NO: 24165 - protein, 444 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKVACKRGGKETKQIEEDGLVDVDGEKSKLAEDLSKIRMVESLDASASKQKLVDCAEEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 24166 - protein, 357 aa, Chlamydomonas reinhardtii
MAAANQKPGPAGRPEPLIGHPRYEKIKDLNSGTFGFVQLARDKLTGETWAVKFIERGDKITKYVEREIINHRCLVHPHIVQFREVFLTPTHLCIVMEFAPGGDMFEYVVRKNGLREDEARWFFQQLIVGLDYCHRMGVVNRDIKLENTLLDSSPRPLVKICDFGYSKHEKFQSAPGSRVGTPAYLAPEVILTTKGKTYDGKIADIWSCGVMLYVMLVGAYPFERPEDKHDNQKLQKMIQRILHVDYHIPPHVRASEDCKDLLAKILVADPHKRITVDGIYNHKWYLKGLPPGVREMNDRVQPPPEGLQSVEEIKRLIEEARHVGVGAPGYVNPVETDEYIDDAMDNMYDEGSLDYND

SEQ ID NO: 24167 - protein, 492 aa, Schistosoma mansoni
MRQLKFFLPYCIITLGSSFPFGYHTGVINAPADLIKSFINTTLAARSVTCDERFIDLLWSLCVTSFLLGGFFGGLIGGVLANKLGRKNSLFLLSIPTVIGSLLMMFSKMAQSFEMIIIGRFTIGIACGAHTVVGPMFLSEIAPVNFRGAAGTFNQFVIVSAILLSQVLSLPEVMGTTELWPYLLALCTVSSVIHILLLFTCPESPTYLYIIKGDRRRSENALVYLRGQDCDVHAELELLKLETEQSSTHKSNVCDLLRIPYLRWGLIVALVPHIGQQFSGINGILYYFVSLFISNGLTKQVASYANLGTGVTILIGAFASIFVIDRKGRRPLLMFGTSVCLFSLLLFTLTLIIKQVTEINKLTILSIVLTYTFLFGFSVSLGSIPWFLVSELFTQENRDAAVSIAAATNWLCNAIVALIFPQLVIYIGIYAFIPFICALLVVLIFVGLYLPETKGKTPASIEDYFMRVCGFRGTEAHENPTFTDIIDDTTQY

SEQ ID NO: 24168 - protein, 382 aa, Strongylocentrotus purpuratus
MGEEIGKIFVGGVDRNTHADTFRAYFEKFGKLSDIILMMDKDKPGQNKGFGFVTFADPACVDDVTNEKNHNLEGKGLDCKRCKARGSEKRMGPGDQRTKKVFVGGISQQATKEDLYELFRSHGNVEDVHIMNDTDTGKHRGFGFVTLDSEEAVEKLVRMHHLELKGKSMEIKKAQPKMNRGFGGPGGQGGPGGPGGFPQGGNWNQGGGQGGYGGGGSNGYGGGNQWGQQMGQYGGGQQGGGYQQQRGGGQQPGYNRQQQQPQSGYGQQGQQSYGGAQSYGSYGGYGQAQQDPTANNNKQHLSSSMQAKDRWVATLKKASGYGPQRGNYNQGYSQAAPQTQTPTPQPPQQQSYAQVDSGQDMYGTNNYGKANMGGNQFHPYSR

SEQ ID NO: 24169 - protein, 376 aa, Brucella melitensis
MCKVMRIGVDARNLVNNITGISRYVMENCRELYERGHELVLYTPEKPRVQLSSSEGFDFRVSNFQGPAGRLFWSQTVLPLQLRKDRIDVFWGPAHRLPALKGAIPSVVSIHDLVWYYASSTMRLQGWLADRFLMKGALRNADQIVAVSYATSSAISSVFPQYTSKIQMVYPGVSHFNRIGTSNILKEHRINKSYGLFIGTLEPRKNLIRLLEAYANLPECVRNNFLLVVAGGKGWNLGDIGKTINRLGIAEYTRLTGYVTDSDLNDLYRNARTLLMPSLYEGFGLPIIEAQAYGVPVITSNCSSMPEVAGDAAILVDPLNVAEISNALYRIATDNKLWQRKSLLALQNIERFNWHNSIEKLESVFIKARESKLMTY

SEQ ID NO: 24170 - protein, 2470 aa, Saccharomyces cerevisiae
MEPHEEQIWKSKLLKAANNDMDMDRNVPLAPNLNVNMNMKMNASRNGDEFGLTSSRFGGVVIGSNGDVNFKPILEKIFRELTSDYKEERKLASISLFDLLVSLEHELSIEEFQAISNDINNKILELVHTKKTNTRVGAVLSIDTLISFYAYTERLPNETSRLAGYLRGLIPSNDVEVMRLAAKTLGKLAVPGGTYTSDFVEFEIKSCLEWLTASTEKNSFSSSKPDHAKHAALLIITALAENCPYLLYQYLNSILDNIWRALRDPHLVIRIDASITLAKCLSTLRNRDPQLTSQWVQRLATSCEYGFQVNTLECIHASLLVYKEILFLKDPFLNQVFDQMCLNCIAYENHKAKMIREKIYQIVPLLASFNPQLFAGKYLHQIMDNYLEILTNAPAKKIPHLKDDKPQILISIGDIAYEVGPDIAPYVKQILDYIEHDLQTKFKFRKKFENEIFYCIGRLAVPLGPVLGKLLNRNILDLMFKCPLSDYMQETFQILTERIPSLGPKINDELLNLVCSTLSGTPFIQPGSPMEIPSFSRERAREWRNKSILQKTGESNDDNNDIKIIIQAFRMLKNIKSRFSLVEFVRIVALSYIEHTDPRVRKLAALTSCEIYVKDNICKQTSLHSLNTVSEVLSKLLAITIADPLQDIRLEVLKNLNPCFDPQLAQPDNLRLLFTALHDESFNIQSVAMELVGRLSSVNPAYVIPSIRKILLELLTKLKFSTSSREKEETASLLCTLIRSSKDVAKPYIEPLLNVLLPKFQDTSSTVASTALRTIGELSVVGGEDMKIYLKDLFPLIIKTFQDQSNSFKREAALKALGQLAASSGYVIDPLLDYPELLGILVNILKTENSQNIRRQTVTLIGILGAIDPYRQKEREVTSTTDISTEQNAPPIDIALLMQGMSPSNDEYYTTVVIHCLLKILKDPSLSSYHTAVIQAIMHIFQTLGLKCVSFLDQIIPTILDVMRTCSQSLLEFYFQQLCSLIIIVRQHIRPHVDSIFQAIKDFSSVAKLQITLVSVIEAISKALEGEFKRLVPLTLTLFLVILENDKSSDKVLSRRVLRLLESFGPNLEGYSHLITPKIVQMAEFTSGNLQRSAIITIGKLAKDVDLFEMSSRIVHSLLRVLSSTTSDELSKVIMNTLSLLLIQMGTSFAIFIPVINEVLMKKHIQHTIYDDLTNRILNNDVLPTKILEANTTDYKPAEQMEAADAGVAKLPINQSVLKSAWNSSQQRTKEDWQEWSKRLSIQLLKESPSHALRACSNLASMYYPLAKELFNTAFACVWTELYSQYQEDLIGSLCIALSSPLNPPEIHQTLLNLVEFMEHDDKALPIPTQSLGEYAERCHAYAKALHYKEIKFIKEPENSTIESLISINNQLNQTDAAIGILKHAQQHHSLQLKETWFEKLERWEDALHAYNEREKAGDTSVSVTLGKMRSLHALGEWEQLSQLAARKWKVSKLQTKKLIAPLAAGARWGLGEWDMLEQYISVMKPKSPDKEFFDAILYLHKNDYDNASKHILNARDLLVTEISALINESYNRAYSVIVRTQIITEFEEIIKYKQLPPNSEKKLHYQNLWTKRLLGCQKNVDLWQRVLRVRSLVIKPKQDLQIWIKFANLCRKSGRMRLANKALNMLLEGGNDPSLPNTVKAPPPVVYAQLKYIWATGAYKEALNHLIGFTSRLAHDLGLDPNNMIAQSVKLSSASTAPYVEEYTKLLARCFLKQGEWRIATQPNWRNTNPDAILGSYLLATHFDKNWYKAWHNWALANFEVISMVQEETKLNGGKNDDDDDTAVNNDNVRIDGSILGSGSLTINGNRYPLELIQRHVVPAIKGFFHSISLLETSCLQDTLRLLTLLFNFGGIKEVSQAMYEGFNLMKIENWLEVLPQLISRIHQPDPTVSNSLLSLLSDLGKAHPQALVYPLTVAIKSESVSRQKAALSIIEKIRIHSPVLVNQAELVSHELIRVAVLWHELWYEGLEDARRQFFVEHNIEKMFSTLEPLHKHLGNEPQTLSEVSFQKSFGRDLNDAYEWLNNYKKSKDINNLNQAWDIYYNVFRKITRQIPQLQTLDLQHVSPQLLATHDLELAVPGTYFPGKPTIRIAKFEPLFSVISSKQRPRKFSIKGSDGKDYKYVLKGHEDIRQDSLVMQLFGLVNTLLKNDSECFKRHLDIQQYPAIPLSPKSGLLGWVPNSDTFHVLIREHRDAKKIPLNIEQWVMLQMAPDYENLTLLQKIEVFTYALDNTKGQDLYKILWLKSRSSETWLERRTTYTRSLAVMSMTGYILGLGDRHPSNLMLDRITGKVIHIDFGDCFEAAILREKYPEKVPFRLTRMLTYAMEVSGIEGSFRITCENVMRVLRDNKESLMAILEAFALDPLIHWGFDLPPQKLTEQTGIPLPLINPSELLRKGAITVEEAANMEAEQQNETRNARAMLVLRRITDKLTGNDIKRFNELDVPEQVDKLIQQATSIERLCQHYIGWCPFW

SEQ ID NO: 24171 - protein, 263 aa, Poa pratensis
MASSSSVLLVVALFAVFLGTAHGIAKVPPGPNITATYGDKWLDAKSTWYGKPTGAGPKDNGGACGYKDVDKAPFSGMTGCGNTPIFKSGRGCGSCFEIKCTKPESCSGEPVLVHITDDNEEPIAAYHFDLSGKAFGAMAKKGEEQKLRSAGELELKFRRVKCEYPEGTKVTFHVEKGSNPNYLALLVKYVTGDGDVVAVDIKEKGKDKWIELKESWGSIWRVDTPDKLTGPFTVRYTTEGGTKGEAEDVIPEGWKADTAYASK

SEQ ID NO: 24172 - protein, 375 aa, Geomys knoxjonesi
MSTAGKVIKCRAAVLWEKNKPFSIEEVEVVPPKAYEVRIKIVATGICRSDDHVVNGSIITPLPAILGHEAGGIVESIGEGVTTVKPGDKVIPLFVPQCGKCRACKHPESNLCTHGDLGRAQGTLMDGTSRFTCKGKPIHHFLGVTTFSEYTVVSEISVTKIDAASPLEKVCLIGCGFSTGYGSAVKVGKVARGSICACVWSGRVGLSAIIGCKAAGAARIIAVDINKDKFAKAKELGATECVNPQDYDKPIYQVLQEMTDGGVDFSFEVIGRLDTMVSALMCCQESHGVSVIVGVPPNAQSLTMDPMVLLSGRSWKGAVFGGYKGKDDVPKLVADFMAKKFPLEPLITNVFPFAKINEGFDLLRAGKSIRTVLTF

SEQ ID NO: 24173 - protein, 375 aa, Geomys bursarius major
MSTAGKVIKCRAAVLWEKNKPFSIEEVEVAPPKAYEVRIKIVATGICRSDDHVVNGSIITPLPAILGHEAGGIVESIGEGVTTVKPGDKVIPLFVPQCGKCRACKHPESNLCKHGDLGRAQGTLMDGTTRFTCKGKPIHHFLGVTTFSEYTVVSEISVTKIDATSPLEKVCLIGCGFSTGYGSAVKVGKVARGSICACVWSGRVGLSAIIGCKAAGAARIIAVDINKDKFAKAKELGATECVNPQDYDKPIYQVLQEMTDGGVDFSFEVIGRLDTMVSALMCCQESHGVSVIVGVPPNAQSLTIDPMVLLSGRSWKGAVFGGYKGKDDVPKLVADFMAKKFPLEPLITNVFPFAKINEGFDLLRAGKSIRTVLTF

SEQ ID NO: 24174 - protein, 375 aa, Geomys attwateri
MSTAGKVIKCRAAVLWEKNKPFSIEEVEVAPPKAYEVRIKIVATGICRSDDHVVNGSIITPLPAILGHEAGGIVESIGEGVTTVKPGDKVIPLFVPQCGKCRACKHPESNLCTHGDLGRAQGTLMDGTSRFTCKGKPIHHFLGVTTFSEYTVVSEISVTKIDAASPLEKVCLIGCGFSTGYGSAVKVGKVARGSICACVWSGRVGLSAIIGCKAAGAARIIAVDINKDKFAKAKELGATECVNPQDYDKPIYEVLQEMTDGGVDFSFEVIGRLDTKVSALMCCQESHGVSVIVGVPPNAQSLTIDPKVLLSGRSWKGAVFGGYKGKDDVPKLVADFMAKKFPLEPLITNVFPLAKINEGFDLLRAGKSIRTVLTF

SEQ ID NO: 24175 - protein, 375 aa, Geomys texensis
MSTAGKVIKCRAAVLWEKNKPFSIEEVEVAPPKAYEVRIKIVATGICRSDDHVVNGSIITPLPAILGHEAGGIVESIGEGVTTVKPGDKVIPLFVPQCGKCRACKHPESNLCTHGDLGRAQGTLMDGTSRFTCKGKPIHHFLGVTTFSEYTVVSEISVTKIDAASPLEKVCLIGCGFSTGYGSAVKVGKVARGSICACVWSGRVGLSAIIGCKAAGAARIIAVDINKDKFAKAKELGATECVNPQDYDKPIYEVLQEMTDGGVDFSFEVIGRLDTMVSALMCCQESHGVSVIVGVPPNAQSLTIDPMVLLSGRSWKGAVFGGYKGKDDVPKLVADFMAKKFPLEPLITNVFPLAKINEGFDLLRAGKSIRTVLTF

SEQ ID NO: 24176 - protein, 340 aa, Malus x domestica
MALKLCDSCKSATGTLFCRADSAFLCVNCDSKIHAANKLASRHARVWLCEVCEQAPAHVTCKADDAALCVTCDRDIHSANPLSHADERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 24177 - protein, 329 aa, Malus x domestica
MASKLCDSCQSATATLFCRADSAFLCVNCDSKIHAANKLASRHPRVWLCEVCEQAPAHVTCKADDAALCVTCDRDIHSANPLSSRHDRVPVTPFYDSVNSAANSVPVVKSVVNFLDDRYLSDVDGETEVSREEAEAASWLLPNPKAMENPDLNSGQYLFQEMDPYLDLDYGHVDPKLEEAQEQNSCGADGVVPVQSKNMQPLLVNDQSFELDFSAGSKPFVYGYHHARCLSQSVSSSSMDISVVPDGNAVTAAVETSQPAVQLSSVDRVARVLRYREKRKNRKFEKTIRYASRKAYAETRPRIKGRFAKRTEVEIEAERMCRYGVVPSF

SEQ ID NO: 24178 - protein, 428 aa, Saccharopolyspora erythraea
MKSAKRRARLATAAVGVTVAVGAAMAPATAAAGPPAPTAQDGVARTPPMGWNSWNSFGCDIDERLIRDTADALVGSGMRDAGYQYVVVDDCWFDPQRDPQGNLRANPERFPSGIRALADYVHSRGLKFGIYQVPTEKTCAQRGGTYPGATGSLGHEEQDARTFAEWGVDYLKYDWCSPEGTLEDQIAAFTKMRDALAATGRPIVYSINSNSYHPDKNGATHDWSPVANMWRTTEDIKPVWDSGNENEYPMGVVNIIDVNRGLAAQARPGHWNDPDMLEVGVYDVEGFKGLTDTEARAHLSMWALMASPLIAGNNVTRMPDGIRDILTNREVVAVDQDPAGAQGVPVRDHGDREVWVKNMADGSRVVALFNRGERPAGIRTTAREAGLPKASEYQVRDLWAHETSTTDGEIRAEVPAHGVVLLRVSAQG

SEQ ID NO: 24179 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMNKTLKPRAVTVFVIGFWILDVANNMLQGPCRALLADLCNGDTRRMRSANALYRFFMAVGNILGNAAGSYNNLYKLFPFSKTHACDLYCANLKSCFIISIVLLIFITVLALTVVREKQWSPDEADEEPPSSGKIPVFGELLRALKDLPRPMLMLLAVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPCKDAAAKLTLSGPYH

SEQ ID NO: 24180 - protein, 386 aa, Candida albicans
MDIVLEICDYYLFDKVYADVFPKDGAVHEFLKPAIQSFSQIDFPSLPNLDSFDTNSTLISSNNFNISNVNPATIPSYLFSKIASYQDKSEIYGLAPKFFPATDFINTSFLARSNIFRETLSLFIITTIFGWLLYFIVAYLSYVFVFDKKIFNHPRYLKNQMSLEIKRATTAIPVMVLLTIPFFLLELNGYSFLYLDINECTGGYKAILWQIPKFILFTDCGIYFLHRWLHWPSVYKVLHKPHHKWIVCTPFASHAFHPVDGFFQSLPYHLYPLLFPLHKVLYLFLFTFVNFWTVMIHDGSYWSNDPVVNGTACHTVHHLYFNYNYGQFTTLWDRLGNSYRRPDDSLFVKDVKAEEEKKIWKEQTRKMEEIRGEVEGKVDDREYVEQ

SEQ ID NO: 24181 - protein, 216 aa, Arabidopsis thaliana
MNSCSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 24182 - protein, 634 aa, Citrus sinensis
MESCDCIDTQWPPDELLVRYQYISDILIALAYFSIPVELIYFVQKSAFFPYRWVLMQFGSFIILCGLTHFISLWTFTVHSKAVAVVMTIAKMACAFVSCITALMLVHIIPDLLSVKTRELFLKNRADELDREMGLILTQEETGRHVRMLTHEIRSTLDRHTILKTTLVELGRTLGLEECALWMPSRTGLNLELSYTLNNQIQIGSSVPINLPIVTDVFNSAQAMRLPYNCPLARIRLLVGRYVPPDIVAVRVPLLHLSNFQINDWPELPAKSYAVMVLMLPTDGGRKWRDHELELIDVVADQVAGALSHAAILEDSMRARNQLMGQNVALDSARREAEKAIHARNDFRAVMNHEMRTLMHAIIALSSLLLETDLTPEQRVMIETVLKSSNLLTTLVDDVLDLSRLEDGSLELDNGPFNLQIVLREVIKLIKPVASCKKLSMTLIMAPELPTYAVGDEKRLMQTILNIVGNAVKFTKEGYVSIIAFVAKPESLSDWRPPKFYPVSTDGHFYLRVQVNDSGCGVPPQDIPLIFTKFAQSRGSSCQTPRAGLGLAICRRFVNLMGGHIWLESEGLDKGSTVTFLVKLGICNNPGSPIHPVALKGRASHGSADLTGPKPLFRDNDQIASTKSRYQRSV

SEQ ID NO: 24183 - protein, 267 aa, Arabidopsis thaliana
MEGCPRNREIGPKLLDLIPQGRKWYQEDKNNTDQEKKLELRLHRGDEEDHSAIKKKNTEIRNIKKETEDKSFHCFNGNHFSPSNKTTSVPHISQKRTAPGPVVGWPPVRSFRKNLASTSSSKLGNESSHGGQINKSDDGEKQVETKKEGMFVKINMDGVPIGRKVDLNAYNSYEQLSFVVDKLFRGLLAAQRDISDGQGEEKPIIGLLDGKGEFTLTYEDNEGDKMLVGDVPWQMFVSSVKRLRVIKSSEISSALTFGCSKQEKMMH

SEQ ID NO: 24184 - protein, 294 aa, Triticum aestivum; identical to SEQ ID NO: 4510

SEQ ID NO: 24185 - protein, 775 aa, Oryctolagus cuniculus
EPTVTKEDKTRAMNYDEEVDETREVSMTKASHSKTKELYEKYMIAEDLGRGEFGIVHRCVETSSKKTFMAKFVKVKGTDQVLVKKEISILNIARHRNILYLHESFESMEELVMIFEFISGLDIFERINTSAFELNEREIVSYVRQVCEALEFLHSHSIGHFDIRPENIIYQTRRSSVIKIIEFGQARQLKPGDNFRLQFTAPEYYAPEVHQHDVVSSATDMWSLGTLVYVLLSGINPFLAETNQQIIENIMNAEYTFDEEAFKEISLEAMDFVDRLLVKERKSRMTASEALQHPWLKQKIDRVSTKVIRTLKHRRYYHTLIKKDLNMVVSAARISCGGAIRSQRGVSVAKVKVASIEIGPVSGQIMHAVGEEGGYVKYVCKIENYDQSTQVTWYFGVRQLENSEKYEITYEDGVATIYVKDITKFDDGTYRCKVVNDYGEDSSYAELFVKGVREVYDYYCRRTMKKIKRRTDTMRLLERPPEFTLPLYNKTAYVGENVRFGVTITVHPEPRVTWYKSGQKIKPGDDDKKYTFESDKGLYQLTINSVTVEDDAEYTVVARNKYGEDSCKAKLTVTPHPPPTDTTLRPMFKRLLANAECQEGQSVCFEIRVSGIPPPTLKWEKDGQPLSLGPNIEIIHEGLDYYALHIRDTLPEDTGYYRVTATNTAGSTSCQAHLQVERLRYVKQEFKSKEERERHVQRQIDKTLRMAEILSGTESVPLTQVAQEALREAAILYKPAVSTKTVKGEYRLETEEKKEERKLRMPYEIPEPRKYKQTT

SEQ ID NO: 24186 - protein, 248 aa, Rosa hybrid cultivar
MAYENKPNTVLDADAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIADNERHQQSINAIAGGHGSYEIMQPTQPFHEARNYFQVNALEPNIHQYSRHDQISLQLV

SEQ ID NO: 24187 - protein, 245 aa, Alcaligenes latus
MTQKLAYVTGGMGGIGTSMCQRLHKDGFKVIAGCGPSRDYQKWLDEQKALGYTFYASVGNVADWDSTVVAFEKVKAEHGTVDVLVNNAGITRDGQFRKMSKADWQAVMSTNLDSMFNVTKQVIDGMLDKGWGRIINISSVNGEKGQFGQTNYSAAKAGMHGFTMALAQEVAAKGVTVNTVSPGYIATDMVKAIRQDVLDKIVSTIPIKRLGTPEEIASIVAWLAGDESGFTTGADFSCNGGLHMG

SEQ ID NO: 24188 - protein, 109 aa, Solanum tuberosum
MEEEKHHHHLFHHKDKEEEGPVDYEKETKHHKHLEQIGKLGTVAAGAYALHEKHEAKKDPEHAHKHKIEEEIAAAAAVGAGGFALHEHHEKKDAKKEQKKAEGGHHHLF

SEQ ID NO: 24189 - protein, 108 aa, Solanum tuberosum
MAEEKHHHHLFHHKNKEEEGGPVDYEKEVKHHSHLEKIGELGAVAAGAFALHEKHKAKKDPENAHKHKIEEEIAAVAAVGAGGFAFHEHHQKKDSKKEKKEAEGGHHY

SEQ ID NO: 24190 - protein, 553 aa, Pichia stipitis
MSSQDIPSGVQTPSNASFLEKDEDKIEEVPQNHDATLVALESKGISEYLLICFFCLLVAFGGFVFGFDTGTISGFVNMSDFLERFGQTRADGTHYLSNVRVGLLVSIFNIGCAIGGIFLSKIGDVYGRRVGIMASMVIYVVGIIVQIASQHAWYQVMIGRAITGLAVGTVSVLSPLFIGESSPKHLRGTLVYCFQLCITLGIFIGYCVTYGTKRLSDSRQWRVPLGLCFLWAIFLVVGMLAMPESPRYLVEKKRIEDAKKSVARSNKLSPEDPSVYTEIQLIQAGIDREAIAGSASWTELITGKPAIFRRVVMGIIMQSLQQLTGVNYFFYYGTTIFQAVGLKDSFQTSIILGVVNFAATFIGIWAIERFGRRSCLLVGSAGMFVCFIIYSTIGSFHLYKDGEYNNDNTYKPSGNALIFITCLFIVFFASTWAGGVYTIISESYPLRIRSKAMAIATAANWVFGFLISFFTPFIVSAIHFKFGYVFSGCLLFSFFYVYFFVVETKGLSLEDVDELYASNVVPWKSSKWVPPSTAAMATEAGYAADEKPVDEHV

SEQ ID NO: 24191 - protein, 550 aa, Pichia stipitis
MSSQDLPSGAQTPIDGSSILEDKVEQSSSSNSQSDLASIPATGIKAYLLVCFFCMLVAFGGFVFGFDTGTISGFLNMSDFLSRFGQDGSEGKYLSDIRVGLIVSIFNIGCAIGGIFLSKIGDVYGRRIGIISAMVVYVVGIIIQISSQDKWYQLTIGRGVTGLAVGTVSVLSPMFISESAPKHLRGTLVYCYQLCITLGIFIGYCVTYGTKDLNDSRQWRVPLGLCFLWAIFLVVGMLAMPESPRFLIEKKRIEEAKKSLARSNKLSPEDPGVYTELQLIQAGIDREAAAGSASWMELITGKPAIFRRVIMGIILQSLQQLTGVNYFFYYGTTIFQAVGLQDSFQTSIILGTVNFLSTFVGIWAIERFGRRQCLLVGSAGMFVCFIIYSVIGTTHLFIDGVVDNDNTRQLSGNAMIFITCLFIFFFACTWAGGVFTIISESYPLRIRSKAMSIATAANWMWGFLISFCTPFIVNAINFKFGFVFTGCLLFSFFYVYFFVSETKGLSLEEVDELYAEGIAPWKSGAWVPPSAQQQMQNSTYGAEAKEQEQV

SEQ ID NO: 24192 - protein, 61 aa, Streptococcus mutans
TPTLLAKVKVEIVAHDAAVEEMITTISQAVKTGEVGDGKIFVSPVDEIVRIRTGERDGDAI

SEQ ID NO: 24193 - protein, 402 aa, Macropus eugenii
MEAHCPGTLFIGGLNVGTNEKDLESVFGKYGHIVKVLLMKDQETNKSRGFAFVTFESPAAAKDAARDMNGKALDGKSIKVEQANKPSFESGRRGPPPAPRSRGPPRGLRHGRGGSGEARGPPRGGHMDDSGYSLNFNMGSSMGPLLVKRGAPPQSGQPSPKRSAPSGPVYSSRQMGGRGQLSGGRDSYGGPPRRESLSSRRDVHMSPRDDSYSTKESYSSRDYASSWDVRGYASFRDPRDYAPLPREYVYRDYGHSSSRDEYTSRGYSDRDSYGGGRDRDYSDHQSGGRYRDSYESYGYSRRAPPPRGPSCYGGSSRYEDYSSTRDGYGYGCGGSQKSYSSSRSGIYSSSRDCVGRQERGLPSAMSRGYPAPHDSYSSSSRGARRGDGRGGSRSERGGRSRY

SEQ ID NO: 24194 - protein, 390 aa, Sminthopsis macroura
MVEADRPGKLFIGGLNTETNEKGLESVFGKYGRIVEVLLMKDRETNKSRGFAFITFESPADAKDAARDMNGKSLDGKSIKVEQATKPSFESGGRRGQPPPPRSRGPPRGLRGGRGGSGGTRGPPRGGHMDDSGYSLNFNVGSSRGPVPVKRGPPPRSGGPPPKRSAPSGPVRSSSGMGGRGPVSRGRDSYGGPPRRDPMSSRRDVYISPRDDSYSTKESRDYGSSRDTRDYAPPPRDYTYRDYGHSSSSRDEYSSRGYSDRDSYGGGRDRDYSDHPSGGSYRDSYESYGNSRSAPPARGPPPSYGGSSRYDDYSSTRDGYGGSRESYSSSRSDIYSSGRDRVGRQERGLPPSMDRGYPAPRDSYSSSSRGAPRGGGRGGSRSERGGRSRY

SEQ ID NO: 24195 - protein, 1216 aa, Mus musculus
MAGAQPGVHALQLKPVCVSDSLKKGTKLVKWDDDSTIVTPTILRTDPQGFFFYWTDQNKETELLDLSLVKDARCGKHAEAPKDPKLRELLDVGNIGHLEQRMITVVYGPDLANISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPDVYRVFLNNLCPRPEIDNIFSEFGAKSKPYLTVDQMMDFINLKQRDPRLNEILYPPLKQEQVQVLIEKYEPNSSLAKKGQMSVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMMALNFQTVDLAMQINMGMYEYNGKSGYRLKPEFMRRPDKHFDPFTEGIVDGIVANTLSVKIISGQFLSDKKVGTYVEVDMFGLPVDTRRKAFTTKTSQGNAVNPVWEEEPIVFKKVVLPSLACLRIAAYEEGGKFIGHRILPVQAIRPGYHYICLRNERNQPLTLPAVFVYIEDKDYVPDTYADVIEALSNPIRYVNLMEQRAKQLAALTLEDEEEVKKEADPGETSSEAPSETRTTPAENGVNHTASLAPKPPSQAPHSQPAPGSVKAPAKTEDLIQSVLTEVEAQTIEELKQQKSFVKLHKKHYKEMKDLVKRHHKKTTELIKEHTTKYNEIQIDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKRQEKITEATSKDKSQMEEEKTEMIRSYIQEVVQYIKRLEEAQSKRQEKLVEKHNEIRQQILDEKPKLQTELEQEYQDKFKRLPLEILEFVQEAMKGKISEDSNHGSAPPSLASDAAKVNLKSPSSEEIERENPGREFDTPL

SEQ ID NO: 24196 - protein, 231 aa, Paramecium tetraurelia
AAAYTINQYMTPEQQPDINIKMRAILVDWLIDVHAKFELKDETLYITISLIDRYLALAQVTRMRLQLVGVAALFIACKYEEIYPPALKDFVYITDNAYVKSDVLEMEGLMLQALNFNICNPTAYQFLQKYSTNLDPKDKALAQYILELALVEYKFIIYKPSQIVQSVIFLVNKIRTPTYKTPNENQLKPCAKELCTLLQTADLSSLQAVRKKFNASKFFEVSRIKVEKTNK

SEQ ID NO: 24197 - protein, 994 aa, Homo sapiens
AKALGAMVKGMGESCFEDLLPWLMETLTYEQSSVDRSGAAQGLAEVMAGLGVEKLEKLMPEIVATASKVDIAPHVRDGYIMMSNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRTLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 24198 - protein, 238 aa, Stylosanthes hamata
MAPREKTPAVKVNGKSNAGVKEVHFRGVRKRPWGRYAAEIRDPGKKSRVWLGTFDTAEDAARAYDAAAREFRGPKAKTNFPFPDSDDINNNNIVVVKNNNRSPSQSSTVESSSRDRDSYSAAAATAVADSSPLDLNLAPQELDSPDPFGSHSTQPFAVFPGGMPAAKQALYLDAVLRASMASHGQFGFGYNRPAAAGAQSDSDSSSVIDLNQNEGDVAKNNGRGLVLDLNEPPPQEMA

SEQ ID NO: 24199 - protein, 239 aa, Stylosanthes hamata
MAPREKTPAVKVNAGVKEVHFRGVRKRPWGRYAAEIRDPGKKSRVWLGTFDTAEDAARAYDAAAREFRGPKAKTNFPFPDSDDINSNNNNIVVVKNNNRSPSQSSTVESSSRDRDSYSAAAAATAVADSSPLDLNLAPAGAGFAGSIRFPFQQPFAVFPGGMPAAKQALYLDAVLRASMASHGQFGFGYNRPAAAAAGAQSDSDSSSVIDLNQNEGDVAKNNGRGLVLDLNEPPPQEMA

SEQ ID NO: 24200 - protein, 113 aa, Rattus norvegicus
DGKKVFLLAGRKRKKSKTSNYLISVDPTDLSRGGDSYIGKLRSNLMGTKFTVYDNGVNPQKASSSTLESGTCARSWQPCAMRQMSRLQGPRKMSVIVPGMNMVHERVCIRPRN

SEQ ID NO: 24201 - protein, 309 aa, Paramecium tetraurelia
MDLAQSEERYQKLEKIGEGTYGLVYKARDNQTGDIVALKKIRMDHEDEGVPSTAIREISLLKEVQHPNIVPLKDVVYDESRLYLIFDFVDLDLKKYMESVPKYMESVPQLDRMQVKKFINQMIQALNYCHQNRVIHRDLKPQNILVDIKQQNTQIADFGLARAFGLPLKTYTHEVITLWYRAPEILLGQRQYSTPVDIWSLGCIFAEMAQKRPLFCGDSEIDQLFKIFKIMGTPKESTWPGVSTLPDFKSSFPRWPNPYQSSCNVQEKILLIYVHQDQISLSKMITYDPLARIPAEEALKHAYFDELNN

SEQ ID NO: 24202 - protein, 269 aa, Escherichia coli
DAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLG

SEQ ID NO: 24203 - protein, 258 aa, Escherichia coli
FDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLG

SEQ ID NO: 24204 - protein, 259 aa, Escherichia coli
EVFDEKALVEEEPSDNDLAEEELLSQGATQRVLDATQLYLGEIGYSPLLTAEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLG

SEQ ID NO: 24205 - protein, 328 aa, Escherichia coli
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALF

SEQ ID NO: 24206 - protein, 355 aa, Neurospora crassa
MCFGGRGKDDEAEASRSRDVDKQIRADEKRLSKEVKLLLLGAGESGKSTILKQMKLIYAQGFSKNEKLEWRPVIFANILQSFRLIFDAMNEFNIKLEDEDNEKNMVQMMVDYEMRGDEPLPLEYFEPAKKLWQDSGVRQAIEKGNEFALHDNLQYFCSDLDRLWDRNYVPSDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 24207 - protein, 464 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVALLTRKIYDGIEVGDKPRLNIKGYIQGNALTDRYIDSNGRIKYANRMGLISDKIYQSAKTNCNGSYFDVDPHNILCLNDLQKVTKCLKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPEYKPEQCLPMVDRWFSGDPL

SEQ ID NO: 24208 - protein, 456 aa, Solanum berthaultii
  unsure (1)..(456): unsure at all Xaa locations
MVLAFIVFVLMLLLTDVVSSHFIVETLPGFDGQLPFKLETGYIGVGEEEKLQLFYFFVESERDPQNDPLMIWLTGGPGCSGLSTFLYEFGPLTFDYANSSGNFPKLELNLHSWTKVANIIFIDQPVGTGYSYAKTSEAYNSNDTLSATLTYDFLRKWLMDHPEYLKNPLYVGSESYAGIYSALVTRKIYDGVEVGDEPQMNIKGYIQGNALTDAYITVNSRVKYVYHMGLISDKIYQSAKANCNGNYVDIDPNNILCLNDLQKVKKCLNNIQSHHILENWCDLSLLRSNVHSGPWCRENNYIYSKIWANDKAVQKALNVREGTILEWVRCNNSMKYSARESMKRSGSYVYEIQSSIDDHRHLTSKSCRALIYSGDHDMIISHVSTEEWIDTLKLPIVDDWEPWFVEDQVAGYKVKYLQNDYELTYATVKGAGHTAPEYKPRQCMSMVDXWFSGDPL

SEQ ID NO: 24209 - protein, 461 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVAPLTRKIYDGIEVGDKPRLNIKGYIQGNALTDRYIDSNGRIKYANRMGLISDKIYQSAKTNCNGSYFDVDPHNILCLNDLQKVTKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPQYKPEQCLPMVDRWFSGDPL

SEQ ID NO: 24210 - protein, 245 aa, Nicotiana tabacum
MGRGRVQLKRIENKINRQVTFSKRRSGLLKKAHEISVLCDAEVGLIVFSTKGKLFEYSTDSCMERILERYERYSYAERQLTATDHETPGSWTLEHAKLKGRLEVLQRNQGHYAGEDLDSLCMKELQNLEHQLDSALKHIRSRKNQLMHESISELQKKDEALQEQNNNLSKQVKEGEKELAQQTQWEQQSHDHLNSSSFVLTQPLSSLHLGEAYPTAGDNGELEGSSRQQQQNTVMPPWMLRHLNG

SEQ ID NO: 24211 - protein, 242 aa, Nicotiana tabacum
MGRGKVQLRRIENKINRQVTFSKRRGGLVKKAHEISVLCDAEVALIVFSHKGKIFEYSSDSCMEQILERYERYSYTERRLLASNSESSVQENWSLEYAKLKAKIDLLQRNHKHYMGEDLDSLNLKDLQNLEQQLDTSLKLIRSRKNQLMHESISMLQKKEKAIQEENNMLSKKIKEKDNTVGQQVEWHQQNQVPTSTSFLLQPHPCLNIGGNYQEEAEEARRNELDLNLDSLYPCHMGCFAT

SEQ ID NO: 24212 - protein, 343 aa, Streptomyces sp. A21
MKRYICRPLADGERAPPENSSTSGGMTSARAGRCRSIHRIQGRVTMTAMSVRTTEAIGTAAQRRDEADAGSHEAVLPWIEDAGKVAPQDARAMSKLFFDRLRTLEEGTHDYQYARNTLIEMNLSLVRFAASRFRNRGGDDTEDIIQVGTIGLIKAIDRFDLSREVEFATFAVPYIVGEIKRFFRDTTWSVHVPRRLQELRVELAKAKEALSADLDRDPTVAELAARLDLSEEEIIEGLVAANGYSAGSLDTPSADSESGNEQRAYADLLGEDDPGMESVENLHALAPLLRQLDDRERAIVRMRFGQEMTQAQIGAELGVSQMHVSRLLSRIVRRLRTGMCVEA

SEQ ID NO: 24213 - protein, 182 aa, Kluyveromyces lactis
MSKENQNVVLVSVEGERFVVDRKIAERSLLLKNYLQDLNSGDLHDDNDADDDEDDEEDGDDEIVMPVPNVRSSVLQKVIEWAVHHKDSNFPDEDDDDSRKAAPVDPWDREFLKVDQEMLYEIILAANYLNIKPLLDAGCKVVAEMIRGRTPEEIRRTFNIVNDFTPEEEAAIRRENEWAEDR

SEQ ID NO: 24214 - protein, 580 aa, Lycopersicon esculentum
MKYLFSKNGGLLEDENSGLYTRDGSVDIKGNPVLKSETGNWRACPFILGNECCERLAYYGIAANLVTYLTKKLHEGNVSAARNVTTWQGTCYITPLIGAVLADAYWGRYWTIATFSTIYFIGMCTLTLSASVPAFKPPQCVGSVCPSASPAQYAIFFFGLYLIALGTGGIKPCVSSFGADQFDDTDPKERVKKGSFFNWFYFSINIGALISSSLIVWIQENAGWGLGFGIPAVFMGIAIASFFFGTPLYRFQKPGGSPLTRMCQVLVAVFHKWNLSVPDDSTLLYETPDKSSAIEGSRKLLHTDELRCLDKAAVVSDNELTTGDYSNAWRLCTVTQVEELKILIRMFPIWATGIVFSAVYAQMSTMFVEQGMVMDTAVGSFKIPAASLSTFDTISVIVWVPVYDKILVPIARRFTGIERGFSELQRMGIGLFLSMLCMSAAAIVEIRRLQLARDLGLVDEAVSVPLSIFWQIPQYFILGAAEIFTFIGQLEFFYDQSPDAMRSLCSALSLLTTALGNYLSSFILTVVTSITTRGGKPGWIPNNLNGGHLDYFFWLLAALSFFNLVIYVFLCQMYKSKKAS

SEQ ID NO: 24215 - protein, 317 aa, Pichia guilliermondii
MSIKLNSGYDMPSVGFGCWKVDNATCADTIYNAIKVGYRLFDGAEDYGNEKEVGDGINRALDEGLVARDELFVVSKLWNSFHDPKNVEKALDKTLSDLKVDYLDLFLIHFPIAFKFVPFEEKYPPGFYCGDGDKFHYEDVPLIDTWRALEKLVEKGKIRSIGISNFSGALIQDLLRSAKIKPAVLQIEHHPYLQQPRLVEYVQSQGIAITAYSSFGPQSFVELDHPRVKDVKPLFEHDVIKSVAGKVKKTPAQVLLRWATQRGLAVIPKSNNPDRLLSNLKVNDFDLSQEDFQEISKLDIELRFNNPWDWDKIPTFI

SEQ ID NO: 24216 - protein, 150 aa, Actinobacillus pleuropneumoniae
MDMPPGTGDIQLTLSQQIPVTGAVVVTTPQDIALLDAVKGISMFQKVSVPVLGIIENMSVHICQNCGHHEDIFGTGGAEKVAKKYGTKVLGQMPLHIRLRQDLDAGTPTVVAAPEHETSRAYIELAAKVASELYWQGSVIPSEIMIREVK

SEQ ID NO: 24217 - protein, 254 aa, Cucumis sativus
  unsure (1)..(254): unsure at all Xaa locations
MSCYEEEDEESGVVGLRRSSSSSRTGRGKIEIKRIENTTNRQVTFCKRRNGLLKKAYELSVLCDAEVALIVFSSRGRLYEYANNSVRATISRYKKAYSDPSTAMTVSEANTQFYQQESAKLRAQIGNLQNLNRHLLGESISSLSVKDLKSLEVKLEKGISRIRSRKNELLFSEIEYMQKREIELHTNNQLIRAKIAETERSXQNTNASNNNGIATRRGEEGSMGTNLEDNNHHQYDSTNYFDPHHNHPISLQLV

SEQ ID NO: 24218 - protein, 280 aa, Myxococcus xanthus
MAEVQRHPLLTREEELQLARHYKESGDVNAAYRLVAWNLRLVVKLAHEYHRNPLSLLDLVLVQEGNIGLMQAVKKYDPERGVKLSSYAAWWIRAYILRYIMDNWKMVKLGTTEAQRKLFFKLRQEQEKLIAQGFEASPKLLAERLNVTEQDVVEMDQRLGHDEMSIDAPLGNDDDSRTTRADRYLPSNSMPADERLGAEQLKALFREKLSEFARTLEGKERFIFESRLVSDEPLTLQDIGDKYGVSRERARQIEAALINRMRDFMREQIPDFDLVASPKA

SEQ ID NO: 24219 - protein, 297 aa, Myxococcus xanthus
MANSTKYAAEGLSHYLRNLGGHQQLTREQEYELARRARKGDESARQTTASSNLAFVVAVAKKFANRGARLDDLIQEGNVGLMKAIEHFDPKKNVRFATYAVWWIRAYITRYLKDNRSQVRGGEAERGSMVDFSLDATIDEDGETTFLDRLEDNSPSPQQVFLAHEQDTEIQEALAKVRKRIGDLGWDILTERLTQDKPLTLEELGQRWGVSREPVRQVELKTKNFLERYLQAFNENEEHHLGERAAGRGVSGHPGPFPPGKARHRGGTDRVIPGRSRLLSFGGCLASDGLLPGKSAC

SEQ ID NO: 24220 - protein, 324 aa, Paramecium tetraurelia
MIIENQRCFGKEIANSSVHQSKEIGMIVEKHKEPFSIIPKVFTTSLDDKENKLFRRESEKIPIEIEIDKSKEHLNPQKVELYSDEILQHLLMEENKYTINQYMTPEQQPDINLKMRAILVDWLVDVHAKFKLKDETLYITISLIDRYLSLAQVTRMKLQLVGVAALFIACKYEEIYPPALKDFVYITDNAYVKSDVLEMEGLMLQALNFNICNPTAYQFLQKYSTDLDPKNKALAQYILELALVEYKFIIYKPSLIAQSVIFLVNKIRTPTHKTQNENQLKPCAKELCTLLQTADLNSLQAVRKKFNATKFFEVSRIKVEKTNN

SEQ ID NO: 24221 - protein, 521 aa, Fundulus heteroclitus
MALMILPFIGALSVSEGLIALVTVCLVYLTLKHFRREIPEGLRRLPGPTPLPIIGNFLELGSKPYLSLTEMSKRFGDVFQIQLGMRPVVILSGYETVKQALTKQGDDFAGRPDLYSFRFINDGKSLAFSTDKAGVWRARRKLAYSALRSFSSLEGKLPEYSCVLEEHICKETEHLIKELHNVMTAEGKFDPFRYIVVSVANVICGMCFGRRYDHHNQELLSLVNLAEDFVQVTGSGNPADFIPALQFLPNKSMKKFVNLNNRFNNFVQKIVSEHYSTFDKDNIRDITDSLIDHCEDRKLDENSNIQMSDEKIVGIVNDLFGAGFDTISTALSWAVMYLVAYPEVEERLYEEIKEKVGLDRTPVMSDRSNLPLLESFILELFRHSSYLPFTIPHCSTKDTSLNGYFIPKDTCVFVNQWQINHDPELWKDPSMFIPDRFLSADGTEVNKQEGEKVLIFGLGRRRCIGEVIARNEVFLFLAIIIQKLHFYKLPGEPVDMTPEYGLTMKHKRCYLGVAMRAKDVQ

SEQ ID NO: 24222 - protein, 242 aa, Corylus avellana
MEFQNQSMSVSPQRKLGRGKIEIKRIENTTNRQVTFCKRRNGLLKKAYELSVLCDAEIALIVFSSRGRLYEYANNSSVKTTIERYKKACADSSNSGSVSEANTQFYQQEAAKLRGQIRSVQDSNRHMLGEALSELNFKELKNLEKNLEKGINRIRSKKNELLLAEIEYMHKREVDLHNNNQFLRAKIAENERNQQNLNVMPGGGNYELMQSQSFDSRNYFQVDALQPNHHYPRQDQMALQLV

SEQ ID NO: 24223 - protein, 150 aa, Actinobacillus pleuropneumoniae
IDMPPGTGDIQLTLSQQIPVTGAVVVTTPQDIALLDAVKGISMFQKVSVPVLGIIENMSVHICQNCGHHEDIFGTGGAEKVAKKYGTKVLGQMPLHIRLRQDLDAGTPTVVAAPEHDTSRAYIELAAKVASELYWQGSVIPSEIMIREVK

SEQ ID NO: 24224 - protein, 394 aa, Macropus eugenii
MVEADRPGKLFVGGLNTETNEKALEAVFGKYGRIVEVLLMKDRETSKSRGFAFITFESPADAKDAARDMNGKLLDGKSIKVEQATKPTFESGGRRGPPPPPRSRGPPRGLRGGGRGGSGGGTRGPPSRGGHMDDSGYSLNFNMGSSRGPLPVKRGPPPRSGGGPPPKRSAPSGPVRSSSGMGGRAPVSRGRDNYGGPPRRDPMPSRRDVYMSPRDDGYNTKDSYSSRDYQSSRDNRDYAPPPRDYAYRDYGHSSSRDEYQSRGYSDRDGYGGRDRDYSDHPSGGSYRDSYESYGNSRSAPPARGPPPSYGGSSRYDDYSRDGYGGSRESYSSSRSDIYSSGRGDRVGRQDRGLPPSMDRGYPPPRDSYSSSSRGAPRGGRGGSRSDRGGGRSRY

SEQ ID NO: 24225 - protein, 510 aa, Plasmodium falciparum
MASGWKADEVFGGVMSYTYDVIICMPGYIDFALSDIDLTNNMTDNITLKTPVISSPMDTVTGHKMSIALALSGGLGVIHNNMSIEKQIEEVKKVKRFENGFIFDPYTFSPEHTVADVLETKNRVGYKSYPITVDGKVGSKLVGIITGIDYLYLTNKSMKIGDIMTTDVVTGSYPINLSDANKVLCDEKKSVLPIVNKNNELIALVCRNDMHKNRIFPHASKSQNKQLIVGASISTREHDLERANQLIKNMIDVICIDSSQGNSIYQIDTIKKIKSAHPDIPIIGGNVVTSQQAKNLIDAGADVLRIGMGSGSICTTQDVCAVGRAQGTAVYHVSKYAHTRNIKTIADGGIKNSGNIVKALSLGADFVMLGNLLAATEESCSEYYFENNVRLKIYRGMGSMEAMYNKGFNSKSRYLVDERKNEYTDENIDEIKVSQGVSASLVDKGSVLNLIPHLFKAVKHGFQSMGIRNIPELHSKLYSGDIRFDVRSFNTIKEGKVSDNLIFNNKKFTT

SEQ ID NO: 24226 - protein, 483 aa, Pseudomonas stutzeri
MNTKLFINNVWVNSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQRVQEAGLPAGVLNYLNSSPDRSPEIADALISAKEIRRINFTGSTRVGSIIAQKAAQHLKRCLLELGGKSPLIVLDDADIDAAVKAAVFGSFLVQGQICMSTERLVVDEKIADEFAAKFAEKAKRLSAGDPCVTGDCIIGPMVSPNSGERINGLFKDAIDKGATVACGGMAQGAVMPATILDHVKSNMRIYDEETFGPITVVIRCSGEAEAIRIASDSAYGLSSGVFGRDINRALRVGMSIEYGSVHINGSTVQSEAQAPYGGTKNTGYGRFDGRAVIDEFTELKWLTIEPFEQQYPF

SEQ ID NO: 24227 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 24228 - protein, 211 aa, Cucumis sativus
MGRGKIEIKRIENSSNRQVTYSKRRNGIIKKAKEITVLCDAQVSLVIFASSGKMHEYCSPSTPLVDILDKYHKQSGKRLWDAKHENLSNEMDRVKKENDNMQIELRHLRGEDITSLNYKELMALEEALENGLTGVREKQSEFMKMMRTNERMMEEENKRLNYELYQKEMVAMGDSVREMDIGYNQRMRDFNSQMPFAFRVQPIQPNLQERE

SEQ ID NO: 24229 - protein, 260 aa, Homo sapiens
MASSGMTRRDPLANKVALVTASTDGIGFAIARRLAQDGAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 24230 - protein, 285 aa, Petunia x hybrida
MEQNQISHSLSNDESITDMGSGNYGCSHYRRRCKIRAPCCDEIFDCRHCHNDSKNSLEVDPHKRHDVPRHDIKRVICSLCNTEQDVQQTCVHCGVCMGKYYCSKCNFFDDDVSKDQYHCDKCGICRTGGNSNFFHCNRCECCYSNMMKESHICVERAMHHNCPVCFEYVFDTTKNITVLPCGHTMHLECVMQMEQHNQYSCPVCSRSYCDMSRVWEKLDQEVASTPMPEMYQNKMVWILCNDCGETSEVNFHIVARKCPNCKSYNTRQTRGGPSSCSSRIEEIVR

SEQ ID NO: 24231 - protein, 589 aa, Cyanidium caldarium
MDWKMMIAAVGIKEGQKESFHLVRAGLLKLATSETDELLIEVANEFIRADPEKRFFLVEALESILKNKKMEEEQLSSVSKSEHRVVKFRKRRQVVKSSRKQRRRYDWRSIDSPYLWEDNSKKTDSSTRNARDNNNNSDHSNECQQVVLSILHNVLQQLSSSPPTRLPLYDWWMEWEYFCKERMQQKQLGRVRETNRHIREQRVVQVLERIQGEEDEVTIDEIEIAAKTVARIMDYSDSYWSDHGNKKNRRRRSTNSDSFSTYLTEIGKVHRLSLEEEKEICQEIAFFTHLEAVREDLRRRIGRLPREHEWAMETNMSVSELRGKLIKGRRAKNRMVAANLRLVICFAKRFRNRGVAFQDLVQEGSIGLIRGVEKYDANRGFRFSTYASWWIRQGIHKALLECSKMFRLPVHVNEMIKEIRRCSYELMNILGREPTKLEIAMKVGMPEEKVIFLLQRAQTALSLEMPLRGSDSSLESRTLGDVVSSTASPSPEDSAFGTSLRYDLERALSQLDFREREVIRMRFGLDDGRTKSLGEVGSLFCVTRERVRQIETRALRKLRDPRCNIFLKEYMEWISDERPGMKKPMAVVD

SEQ ID NO: 24232 - protein, 433 aa, Pneumocystis carinii f. sp. ratti
MGIFKIHARSFYDSRGNPTVEVEVTTETGVHRANVPSGASTGIHEALELRDNGSSWSGKGVTLAVSNVNDIIAPSLLSAGIDIKDQRSIDKFLIDLDGTSNKSRLGANAILGVSIAICKAAAAEKGVPLYRHFADIADIKEPFILPLPCFNVLNGGSHAGGRLAFQEFMILPTSAVTFHEAMQQGSEVYSALKKLSRKRYGHSAGNAGDEGGVAPDIQTADEALDLIVTAIEEAGYTGKIKIALDVAASEFYKNGKYDLDFKNPESDSSQHKTSKELADIYLDLSKKYPIVSIENPVDRDDWDAWIYVSRRATFQMVGDDLTVTNVSRINEAADKKACNCLLLKINQIGTISESIDAFKTAFDAGWGVMVSHRSGETEDTVIADLVVGLGTGQIKTGAPCRSERVAKYNQLLRIEEELNHSVYASMNYIKNIK

SEQ ID NO: 24233 - protein, 175 aa, Brassica napus
MEWEEQGLRSSLVLDSASVLMLTASALTATVLSSLVELLAQVAALEGDVKENGDKVVDAEEGNGNNEDGDSRDDGGEDKEEEGGDAEEVKETKKGSSSRSGENGEAGDGDDDDDKPEGYDNDDDDDENENNDDDDDDEEEDDDGGEEDEEEVEEEEEEEEDEEEEALQPPKKRKK

SEQ ID NO: 24234 - protein, 550 aa, Pichia stipitis
MSSQDLPSGAQTPIDGSSILEDKVEQSSSSNSQSDLASIPATGIKAYLLVCFFCMLVAFGGFVFGFDTGTISGFLNMSDFLSRFGQDGSEGKYLSDIRVGLIVSIFNIGCAIGGIFLSKIGDVYGRRIGIISAMVVYVVGIIIQISSQDKWYQLTIGRGVTGLAVGTVSVLSPMFISESAPKHLRGTLVYCYQLCITLGIFIGYCVTYGTKDLNDSRQWRVPLGLCFLWAIFLVVGMLAMPESPRFLIEKKRIEEAKKSLARSNKLSPEDPGVYTEVQLIQAGIDREAAAGSASWMELITGKPAIFRRVIMGIILQSLQQLTGVNYFFYYGTTIFQAVGLQDSFQTSIILGTVNFLSTFVGIWAIERFGRRQCLLVGSAGMFVCFIIYSVIGTTHLFIDGVVDNDNTRQLSGNAMIFITCLFIFFFACTWAGGVFTIISESYPLRIRSKAMSIATAANWMWGFLISFCTPFIVNAINFKFGFVFTGCLLFSFFYVYFFVSETKGLSLEEVDELYAEGIAPWKSGAWVPPSAQQQMQNSTYGAEAKEQEQV

SEQ ID NO: 24235 - protein, 115 aa, Populus tremula x Populus tremuloides
MARTTSRDAQALFQSLRSAYTATPTSLKIIDLYVVFAVFTAIIQVVYMAIVGSFPFNSFLSGVLSCVGTAVLAVCLRIQVNKENKEFKDLAPERAFADFVLCNLVLHLVIMNFLG

SEQ ID NO: 24236 - protein, 743 aa, Drosophila melanogaster
MASEITNGKNGQNGKNGQKEESDSQIAPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGTGGIKPCVSAFGGDQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGLLLAALGFFLSAGLEMKMEQAAYRATPIEPDMTHLRIYNGMPCRYEISSAVVQTPRVIEPLNVWEDLSLQMTESKEYTFNAQPVSGECPSIIDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVAPSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 24237 - protein, 737 aa, Drosophila melanogaster
MAFVSNAIVGPENCKSVTVSLPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGTGGIKPCVSAFGGDQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGLLLAALGFFLSAGLEMKMEQAAYRATPIEPDMTHLRIYNGMPCRYEISSAVVQTPRVIEPLNVWEDLSLQMTESKEYTFNAQPVSGECPSIIDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVAPSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 24238 - protein, 282 aa, Perilla frutescens
GSWRSLPKLAGLLRCGKSCRLPWTNYLRPDIKRGPFSTEEEKLVIQLHGILGNRWAAIASQLPGRTDNEIKNLWNTHLKKRLLLMGIDPHTHEPSLTSNGLLTRPPSSPSTRHMAQWESPRLDAEARLSKESLLSIHAPLPKSEADHFLRLSNSEVGETFRKIKNGEKAEPPSPSQSPGSSASTKCCSFSGTTTEIGLQSGLHETDCKSSKTCTEYVRTGTDSSSSNEMEDSSESTLQLLLDFPCKNDMSFLGNADCYSLYPGFTNGSLYDSSSQEKKGGFV

SEQ ID NO: 24239 - protein, 421 aa, Oryza sativa (indica cultivar-group)
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAATTSAVVDPVEYNAMLKQKLEKDLAAVAMWKASGTVPPERPGAGSSLLNADVSHIGAPISIGGNATPVQNMLSGPSGGSGSQLVQNVDVLVKQPTSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRPASLQRVASLEHLQKRMCGGPASSGSTS

SEQ ID NO: 24240 - protein, 298 aa, Rana rugosa
MTDAAISFAKDFLAGGVAAAISKTAVAPIERVKLLLQVQHASKQITADKQYKGIMDCVVRIPKEQGFVSFWRGNLANVIRYFPTQALNFAFKDKYKKIFLDNVDKRTQFWRYFAGNLASGGAAGATSLCFVYPLDFARTRLAADVGKAGADREFKGLGDCLAKIFKSDGLKGLYQGFNVSVQGIIIYRAAYFGIYDTAKGMLPDPKNTHIFISWMIAQTVTAVAGFASYPFDTVRRRMMMQSGRKGAEIMYSGTIDCWKKIARDEGSRAFFKGAWSNVLRGMGGAFVLVLYDELKKYI

SEQ ID NO: 24241 - protein, 298 aa, Rana rugosa
MTDAAISFAKDFLAGGVAAAISKTAVAPIERVKLLLQVQHASKQITADKQYKGIMDCVVRIPKEQGFVSFWRGNLANVIRYFPTQALNFAFKDKYKKIFLDNVDKRTQFWRYFAGNLASGGAAGATSLCFVYPLDFARTRLAADVGKAGADREFKGLGDCLAKIFRSDGLKGLYQGFNVSVQGIIIYRAAYFGIYDTAKGMLPDPKNTHIFISWMIAQSVTAVAGFASYPFDTVRRRMMMQSGRKGAEIMYSGTIDCWKKIARDEGSRAFFKGAWSNVLRGMGGAFVLVLYDELKKYI

SEQ ID NO: 24242 - protein, 298 aa, Rana rugosa
MTDAAISFAKDFLAGGVAAAISKTAVAPIERVKLLLQVQHASKQITADKQYKGIMDCVVRIPKEQGFVSFWRGNLANVIRYFPTQALNFAFKDKYKKIFLDNVDKRTQFWRYFAGNLASGGAAGATSLCFVYPLDFARTRLAADVGKAGADREFKGLGDCLAKIFRSDGLKGLYQGFNVSVQGIIIYRAAYFGIYDTAKGMLPDPKNTHIFISWMIAQTVTAVAGFASYPFDTVRRRMMMQSGRKGAEIMYSGTIDCWKKIARDEGSRAFFKGAWSNVLRGMGGAFVLVLYDELKKYI

SEQ ID NO: 24243 - protein, 978 aa, Populus tremuloides
MMESGAPICHTCGEQVGHDANGELFVACHECSYPMCKSCFEFEINEGRKVCLRCGSPYDENLLDDVEKKGSGNQSTMASHLNDSQDVGIHARHISSVSTVDSEMNDEYGNPIWKNRVKSCKDKENKKKKRSPKAETEPAQVPTEQQMEEKPSAEASEPLSIVYPIPRNKLTPYRAVIIMRLVILGLFFHFRITNPVDSAFGLWLTSVICEIWFAFSWVLDQFPKWNPVNRETYIERLSARYEREGEPSQLAGVDFFVSTVDPLKEPPLITANTVLSILAVDYPVDKVSCYVSDDGAAMLSFESLVETAEFARKWVPFCKKFSIEPRAPEFYFSQKIDYLKDKVQPSFVKERRAMKRDYEEYKVRVNALVAKAQKTPEEGWTMQDGTPWPGNNTRDHPGHDSGLPWEILGARDIEGNELPRLVYVSREKRPGYQHHKKAGAENALVRVSAVLTNAPYILNVDCDHYVNNSKAVREAMCILMDPQVGRDVCYVQFPQRFDGIDKSDRYANRNVVFFDVNMKGLDGIQGPVYVGTGCVFNRQALYGYGPPSMPSLRKRKDSSSCFSCCCPSKKKPAQDPAEVYRDAKREDLNAAIFNLTEIDNYDEHERSMLISQLSFEKTFGLSSVFIESTLMENGGVPESANSPPFIKEAIQVIGCGYEEKTEWGKQIGWIYGSVTEDILSGFKMHCRGWRSIYCMPVRPAFKGSAPINLSDRLHQVLRWALGSVEIFFSRHCPLWYGFGGGRLKWLQRLAYINTIVYPFTSLPLIAYCTIPAVCLLTGKFIIPTLSNLASMLFLGLFISIIVTAVLELRWSGVSIEDLWRNEQFWVIGGVSAHLFAVFQGFLKMLAGIDTNFTVTAKAAEDAEFGELYMVKWTTLLIPPTTLLIINMSGCAGFSDALNKGYEAWGPLFGKVFFAFWVILHLYPFLKGLMGRQNLTPTIVVLWSVLLASVFSLVWVKINPFVNKVDNTLVAETCISIDC

SEQ ID NO: 24244 - protein, 114 aa, Citrus unshiu
ARSTGKDAQALFHSLRSAYAATPTTLKIIDLYVGFAVFTSVIQVVYMAIVGSFPFNSFLSGVLSCVGTAVLAVCLRIQVNKDNKEFKDLPPERAFADFVLCNLVLHLVIMNFLG

SEQ ID NO: 24245 - protein, 793 aa, Chara corallina
MAAVAEGLNAMTTIPTTTAPADLALAAVTGNTIVSETAVLIFIPAACVIGILFAVLQWSVVGKISVRPSGGGMNYPLMGDEGLEDSSVVTRCAEIQEAISEGAVSFLMTEYKYLSYFMVGFFIVIFAFLGATEDFGTDRKPCEWDATKLCGSGVMNALLSAVAFALGAITSTLCGFLGMKIATFANARTRSRRGGGVGPAFKAAFRSGAVMGFLLTSLGLIVLYFTILIFQRYYGDDWIGLYESIAGYGLGGSSVALFGRVGGGIYTKAADVGADLVGKVERNIPEDDPRNPAVIADNVGDNVGDIAGMGADLFGSLAESTCAALVVSSLSDFGKEMNYVAMSFPLLITGAGILVCLITTLVATDLTSGVSNIKGIEPALKQQLVISTVLMTPVIALLAWGCLPDTFEIINGAETKVVKKWYMFFCVACGLWAGLLIGYTTEYFTSHQFTPVRDVADSCRTGAATNVIFGLALGYKSVIIPILAIAFTVFVSHTLAAMYGIACAALGMLSTLSTCLAIDAYGPISDNAGGIAEMAEMGPAIREKTDALDAAGNTTAAIGKGFAIGSAALVSLALFGAYINRAGITSVDVILPKEFVGLIVGAMLPYWFSAMTMKSVGKAALAMVEEVRRQFNTIAGLMQGTVKPDYKRCVEISTDASLREMIPPGCLVMLTPLVVGGLLGKETLAGILAGALVSGVQIAISASNTGGAWDNAKKYIEAGGNDHARTLGPKGSDCHKAAVIGDTVGDPLKDTSGPSLNILIKLMAVESLVFAPFFKTYGGVLFVLWDKFVAGKY

SEQ ID NO: 24246 - protein, 945 aa, Gallus gallus
SGTPGIQVPVSPTVPLQNQKYVPNSTDSPGPSQISNAAVQTTPPHLKPAAEKLLVVNQNMQPLYVSKRSNGVTQKIQLTPSVSSAQSVMETNASVLGPVGSGLTLTTGLNPSLPSSQSLYPPTSKGLLPMSHHQHIHPFSTATQTGFPPNIGSPSPGLLIGVQPPPDPQLLVSEANQRTDLGTAASTPAAALSKKRPISRLQSRKNKKLAPSGTPSAIAPPDMVSNMTLINFAPSQISNHPLDLGTIANSTSHRTVPNIIKRSKSGVMYFEQTSLLPQSGTATAVGTSPNVIGPDAGHLPPGPVSGLASSSSVLNVVSMQATAAPTTGGSVPSHVLGQSSVTLTSPGLLGDIGSISNLLIKASQQSLGLQEQHMTLPPASGMFSQLGTSQTPSTAAMTAASSICVLPSAQSMSMTVAQSSTDPEGSYQLQHMTQLLASKTGIASSQLDLGTASATAQLSSFPQLVDVPNSTGLEQNKVSSSVMHASSASPGGSPSSGQQSASSSVLGSSKMKPKIKRIQPSLEKGNGKKHKTSHMWTGSSEAHVPDRGTTAAPQVSAARTPAVKTDVQDAACTDQPSQTQCGQSTGHTAVLPESQSTQTSTNEQEKSGSKAIEEEESTFSSPLMFWLQQEQKRKECLGEKKPKKGLVFEISSDDGFQICAESIEDAWKSLTDKVQEARSNARLKQLSFAGVNGLRMLGIIHDTVVFLIEQLYGAKHCHNYKFRFHKPEEANELSNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYSGNVIRSILTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 24247 - protein, 621 aa, Burkholderia cepacia
MKLRALIKLGKERGFLTYAEINDHLPDNFTETEALEGIIGTFNDMGVAVYEQAPDAETLLLNDNAPAASSDDEVEEEAEVALSTVDSEFGRTTDPVRMYMREMGTVELLTREGEIEIAKRIEDGLRHMVMAISACPTTIADILAMAERVANEEIRVDELVDGLLDPNAADAADTDGFSAKEAEAIENEDEEAEEEEEEEEEEDDDGAAQATANAAQLEALKRASLEKFSQISEWFDKMRRAFEKEGYKSKSYLKAQETIQTELMTIRFTARTVERLCDTLRAQVDEVRQVERQILHIVVDKCGMPRSEFIARFPGSETDLDWAEKIAAEGHSYSAVLSRNIPAIREQQQRLLDLQARVVLPLKDLKETNRQMAAGELKARQAKREMTEANLRLVISIAKKYTNRGLQFLDLIQEGNIGLMKAVDKFEYRRGYKFSTYATWWIRQAITRSIADQARTIRIPVHMIETINKMNRISRQILQETGLEPDPATLAEKMEMPEDKIRKIMKIAKEPISMETPIGDDDDSHLGDFIEDNNTVAPADAALHASMRDVVKDVLDSLTPREAKVLRMRFGIEMSTDHTLEEVGKQFDVTRERIRQIEAKALRKLRHPSRSDKLKSFLEGN

SEQ ID NO: 24248 - protein, 443 aa, Burkholderia cepacia
MLTHQENELLCRVEGDAPMGQLMRRHWTPVCLIEEVSEPDGAPVKARVFGEDLVVFRDSEGNVGVLDEYCPHRRASLVYGRNEDSGLRCLYHGWKFDVAGNVLEMVSEPAASSMTDKVKHKAYPVQEWGGMVWAYMGPQDAIPEFVPPAWAPTADTRVSIAKALLPCNWAQILEGAIDSAHSSSLHSSDFVPARVGGAEATDKNWLRPSTDKAPRLQVERTDYGFRYAALRRPIFNANTHDYVRCTVFVAPGTVLIPPNNLYNVANINVPMDDTNTAFYFIAWGDPETTPENETWRKFLRQQVGVDLDQYYRPLRNHDNRFWQDRQAMKAGNFTGISGFPNQDIAMWVTMGPIANRSDERLGGSDLAIVEFRRRMLDAITEFQQGDGTIGTGAKAIPREVCSYQAVVPKEIDWRTYAARYVSKKNPEPADQPSALATDYQVKQ

SEQ ID NO: 24249 - protein, 422 aa, Caenorhabditis elegans
MISQFEIIGDNKIGVLPKQVDQLQMCRDIAASKDLQENDSSFMLVDLDKIIERFQLWKRELPMIEPFYAVKCNTDLVLIRILASLGCGFDCASKDEIDIVMGTGVSAERIIYANPCKTRSFIAHAMDRDVKMMTFDNPEELLKIAKLHPNAEMILRIAVSDPTATCPLNLKFGADPIIAAPQLLKTASEEGINVVGISFHVGSGCNDASAYRNALQHAKNLCEIGEGLGFKMDIIDMGGGFPGAEHHNPFEKIAETIRDALDEFFPDTNKRLYREPGRFFAAGPFSLVANIIHATEVPASKITKDPKDCADHGYMYYINDGVYGSFNCILFDHAHPIGSPLFDTDRNEKFMSTIWGPTCDSLDLVEDKKLMPKMNVGEWLYYPDMGAYTLAAATTFNGFSKPVPMYVMSEEMWESIRDSTHV

SEQ ID NO: 24250 - protein, 272 aa, Oryza sativa (indica cultivar-group)
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 24251 - protein, 519 aa, Vitis vinifera
MPAVGGFDKGTGKAYPGNLTPYVTVTCVVAAMGGLIFGYDIGISGGVTSMAPFLQKFFPSVYRKEALDKSTNQYCKFDSETLTLFTSSLYLAALLSSLVAATVTRKFGRKLSMLFGGLLFCAGAIINGAAKAVWMLIVGRILLGFGIGFANQSVPLYLSEMAPYKYRGALNIGFQLSITIGILVANILNYFFAKIKGGWGWRLSLGGAVVPALIITVGSLVLPDTPNSMIERGQHEGAKTKLRRIRGVDDVEEEFNDLVVASEASKLVEHPWRNLLQRKYRPHLTMAILIPFFQQLTGINVIMFYAPVLFKTIGFADDASLMSAVITGRVNVLATIVSIYGVDKWVRRFLFLEGGTQMLICQVIVATCILVKFGVDGEPWCLPKWYAIVVVLFICVYVSGFAWSWGPLGWLVPSEIFPLEIRSAAQSVNVSVNMFFTFIIAQIFLNMLCHMKFGLFLSFAFFVVVMSFFIYFFLPETKGIPIEEMAEVWKSHWFWSRYVNDGSYSGVELVKENYPVKNV

SEQ ID NO: 24252 - protein, 519 aa, Vitis vinifera
MPAVGGFDKGTGKAYPGNLTPYVTVTCVVAAMGGLIFGYDIGISGGVTSMAPFLQKFFPSVYRKEALDKSTNQYCKFDSETLTLFTSSLYLAALLSSLVAATVTRKFGRKLSMLFGGLLFCAGAIINGAAKAVWMLIVGRILLGFGIGFANQSVPLYLSEMAPYKYRGALNIGFQLSITIGILVANILNYFFAKIKGGWGWRLSLGGAVVPALIITVGSLVLPDTPNSMIERGQHEGAKTKLRRIRGVDDVEEEFNDLVVASEASKLVEHPWRNLLQRKYRPHLTMAILIPFFQQLTGINVIMFYAPVLFKTIGFADDASLMSAVITGGVNVLATIVSIYGVDKWGRRFLFLEGGTQMLICQVIVATCIGVKFGVDGEPGALPKWYAIVVVLFICVYVSGFAWSWGPLGWLVPSEIFPLEIRSAAQSVNVSVNMFFTFIIAQIFLNMLCHMKFGLFLFFAFFVVVMSFFIYFFLPETKGIPIEEMAEVWKSHWFWSRYVNDGSYSGVELVKENYPVKNV

SEQ ID NO: 24253 - protein, 1010 aa, Xenopus laevis
QRSREINYAQFAMLYRSLMYDAQKTIPIPFTETFGEGERTKISLEDFQKFLLDYQKDMWATDLHKVQEFMFHFLHEPLREIEEPYFTLEEFVTFLFSKENTVWDLELDTVCPQNMDNPLSHYWISSSHNTYLTGDQFSSESSLEAYARCLRMGCRCIELDCWDGPDGMPAIYHGHTLTTKIKFSEVLSTIKEHAFVTSEYPVILSIEDHCSIAQQRNMAQHFKKVFGDMLLTKPVDVNADGLPSPNQLKRKILIKHKKLAEGSTYEEIPSSTVYSENDISNSIKNGILYLQDPINHEWYPHFFVLTSSKIYYSEETTGNQANDDEEEQKEASNSSELHSAEKWFHGKLGAGRDGRHIAERLLTDYCIETGAPDGSFLVRESETFVGDYTLSFWRNGKVQHCRIHSRQEAGSPKFFLTDNLVFESLYALITHYQQMPLRCNEFEMRLTEPVPQTNAHESKEWYHASLTRGQAEHMLMRVPRDGAFLVRKRSEQNSYAISFRAEGKIKHCRVIQEGQSVVLGSSEFDSLVDLISYYEKHPLYRKMKLRYPINEETLEKIGTPDPDYGALYEGRNPGFYVEANPMPTFKCSVRALFDYKAQREDELTFTKNTIIQNVEKQEGGWWRGDCGGKKQMWFPANYMEEIFSPPEPEPERQHLDENSPLGDLLGGVLDVPSCHIVPRQDVFNGRPFVFTITGPQLNRYPLDVAADTLEDMQDWIRKIREAAQTADARLTEGKIMERRKKIALELSELVIYCRPVPFDEEKIGTEKACYRDMSSFPETKAEKYVNKMKGKKFLQYNRRQLSRIYPKGQRLDSSNYDPLTMWICGSQLVALNFQTPDKPMQMNQALFQSGGRCGYVFQPNCMRDEMFDPFDKGTLLLETITISIEILGARHLPKIGRGIVCPFVEVEVCGTEYDNAKQKTEFVVDNGLNPVWPQKTFSFVVANPEFAFLRFVVYDEDMFSDQNFLAQASFVVRGLKTGYRAIPLKNNYTEDLELALLLIKIDIKTENGEL

SEQ ID NO: 24254 - protein, 1067 aa, Xenopus laevis
NSREEVNMWIKGLNWLLQDTLQAPTPLQIERWLRKQFYTLDRNREDKISVKDLKNMLSQVNYRVPNMRFLRDRLTELEQRSREINYAQFAMLYRSLMYDAQKTIPIPFTERFGERERTKVSLEDFQKFLLDYQKDMWATDRHKVQEFMFHFLHEPLREIEEPYFTLEEFVTFLFSKENTVWDSELDTVCPQNMDNPLSHYWISSSHNTYLTGDQFSSESSLEAYARCLRMGCRCIELDCWDGPDGMPVIYHGHTLTTKIKFSEVLITIKEHAFVTSEYPVILSIEDHCSIAQQRNMAQHFKKVFGDMLLTKPVDVNADGLPSPNQLKRKILIKHKKLAEGSTYEEIPSSTVYSENDISNSIKNGILYLQDPINHEWYPHFFVLTSSKIYYSEETTGSQANDDEEEQKEASNSSELHSAEKWFHGKLGAGRDGRHIAERLLTDYCIETGAPDGSFLVRESETFVGDYTLSFWRNGKVQHCRIHSRQEAGSPKLLLTDNLVFESLYALITHYQQMPLRCNEFEMRLTEPVPQTNAHESKEWYHASLTRGQAEHMLMRVPRDGAFLVRKRSEQNSYAISFRAEGKIKHCRVIQEGQSVVLGSSEFDSLVDLISYYEKHPMYRKMKLRYPINEETLEKIGTPDPDYGALYEGRNPGFYVEANPMPTFKCSVRALFDYKAQREDELTFTKNTIIQNVEKQEGGWWRGDCGGKKQMWFPANYVEEIFSPAEPEPERQNLDENSPLGDLLGGVLDVPSCHIAPRQDVHNGRPFVFTITGPQLNRYPLDVAADTLEDMQDWIRKIREAAQTADARLTEGKIMERRKKIALELSELVIYCRPVPFDEEKIGTEKACYRDMSSFPETKAEKYVNKMKGKKFLQYNRRQLSRIYPKGQRLDSSNYDPLTMWICGSQLVALNFQTPDKPMQMNQALFQSGGRCGYVFQPNCMRDEVFDPFDKSTLRLETITVSIEILGARHLPKIGRGIVCPFVEVEVCGTEYDNAKQKTEFVVDNGLNPVWPQKTFSFVIANPEFTFLRFVVYEEDMFSDQNFLAQASFVVRGLKTGYRSIPLKNNYS

SEQ ID NO: 24255 - protein, 352 aa, Cryptococcus neoformans var. grubii
MQDIQDKIAAARREADGLKDKLRAARDQTADTSLRAMATDTPPLPRITLKARRTLKGHLAKIYALHWAADTRHIVSASQDGKLIVWDAYTTNKVHAIPLRSSWVMTAAYAPSGNLVACGGLDNVCSIYSLRGAGPGAPGAPGGQVKVARELSAHSGYLSCCRFINDRQIVTSSGDMTCMLWDIEQGTRTMEFNDHTGDVMCISLAPNANLFVSGACDATAKVWDIRTGKAVQTFTGHESDINAVQFFPNGDAFATGSDDASCKLFDLRADRELNSYAHDNILCGITSVAFSISGRVLFAGYDDYNCNVWDTLKGERIGVLAGHENRVSCMGVSGDGVALCTGSWDSLLKVWS

SEQ ID NO: 24256 - protein, 636 aa, Vigna radiata
MMESCDCIDTQYPPDELLVKYQYISDVLIALAYFSIPVELIYFVQKSAFFPYRWVLMQFGAFIVLCGATHFINLWTFSPHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRNGLNLQLSHTLTYHVQVGSTVQTNNPIVNEVFNSPRAMRIPPTCPLARIRPLVGRYVPPEVVAVRVPLLNLSNFQINDWPDISAKNYAIMVLILPTDSVRRWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILAPDLPTHAIGDEKRLTQTLLNVVGNAVKFTKEGYVSIRASVAKPESLQDWRPPEFYPTSSDGHFYIRVQVKDSGCGIPPQDIPHLFTKFAQSRSGPARPSSGAGLGLAICKRFVNLMGGHIWIESEGPGKGSTATFIVKLGICGNPDPSDHQATTRSQAYSGSGGLARFKPFIKDEDDSGFSTRRNQRSF

SEQ ID NO: 24257 - protein, 244 aa, Mesocricetus auratus
MKLNFTGLRALVTGAGRGIGRGTAKALHASGAKVVAVSLINEDLVSLAKECPGIEPVCVDLGDWEATEKALGRIGPVDLLVNNAAVALVQPFIQSTKEVFDRSFNVNVRSVLQVSQMVAKGMINRGVAGSIVNISSMVAYVTFPGLATYSSTKGAITMLTKAMAMELGPYKIRVNSVNPTVVLTDMGKKVSADPEFAKKLKERHPLRKFAEVEDVVNSILFLLSDSSASTSGSGILVDAGYLAS

SEQ ID NO: 24258 - protein, 517 aa, Homo sapiens
  unsure (1)..(517): unsure at all Xaa locations
MATTVTCTRFTDEYQLYEDIGKGAFSVVRRCVKLCTGHEYAAKIINTKKLSARDHQKLEREARICRLVKHSNIVRLHDSISEEGFHYLVFDLVTGGELFEDIVAREYYSEADASHCIQQILXAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 24259 - protein, 542 aa, Homo sapiens
  unsure (1)..(542): unsure at all Xaa locations
MATTVTCTRFTDEYQLYEDIGKGAFSVVRRCVKLCTGHEYAAKIINTKKLSARDHQKLEREARICRLVKHSNIVRLHDSISEEGFHYLVFDLVTGGELFEDIVAREYYSEADASHCIQQILXAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 24260 - protein, 299 aa, Homo sapiens
  unsure (1)..(299): unsure at all Xaa locations
XMENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 24261 - protein, 431 aa, Rattus norvegicus
ADKLPYKVADIGLAAWGRKALDIAENEMPGLMRMREMYSASKPLKGARIAGCLHMTVETAVLIETLVALGAEVRWSSCNIFSTQDHAAAAIAKAGIPVFAWKGETDEEYLWCIEQTLHFKDGPLNMILDDGGDLTNLIHTKHPQLLSGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYLLKNGHRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 24262 - protein, 95 aa, Gallus gallus
KSRSSRAGLQFPVGRVHRLLRKGNYAERVGAGAPVYLAAVLEYLTAEILELAGNAARDNKKTRIIPRHLQLAIRNDEELNKLLGKVTIAQGGVLP

SEQ ID NO: 24263 - protein, 76 aa, Gallus gallus
QGITKPAIRRLARRGGVKRISGLIYEETRGVLKVFLENVIRDAVTYTEHAKRKTVTAMDVVYALKRQGRTLYGFGG

SEQ ID NO: 24264 - protein, 526 aa, Xenopus laevis
MTDWIGSIAGLMANTTITEFLLVSTVFAIVFLVLRSERVKIPPGTKKLPGPMPYPIIGNLLSLSKNPHLSLTRMSKTYGDVFQIQIGTKPVLVLSGLETLKQALIRQGDEFAGRPDLFTFRLVGDGKSLTFSSDSGEVWRARRRLAHNALKTFATSPSPTSSSSCLVEENIITEAEYLVRKFKQLIDEKGEFDPYRYVVVSVANVICGMCFGKRYNHDDEELLNVVNLTDEFGAAAASGNPADFIPILQYLPSSSMKAFKEINRKFLDFIQKLVKEHYKTFDKNHIRDITDSLIQHSQEKRVDENSNVQLSNQKIVNIVNDLFGAGFDTITTALSWSLMYLVAHPNIQEKIQDELDQVIGRERRPRLSDRAQLPYTEAFILEMFRHSSFVPFTIPHSSTTDTVLNGYFIPKGICVLINQWQVNHDPNLWKDPFKFCPERFLNTDGTTLNKIEMEKVMIFGLGKRRCVGEVIGRMEVFLFLTTMLQQMQFFKQDGEKLDMSPQYGLTMKHKRCHVTAKIRFPLLATH

SEQ ID NO: 24265 - protein, 526 aa, Xenopus laevis
MTNWIGTVAGMMANTTITEFLVASVVFAIVFLVIRSQRVKIPPGTKKLPGPMPYPVIGNLLSLSKNPHLSLTRMSETYGDVFQIQIGTKPVLVLSGLETLKQALIRQGDEFAGRPDLFTFRMVGDGQSMTFSSDSGEVWRARRRLAQNALKTFATSPSPTSSSSCLVEENIITEAEYLVKKFMQLIDEKGEFDPYRYVVVSVANIICGMCFGKRYNHDDEELLNVVNLTDEFGAAAASGNPADFIPILQYLPSSSMKAFKEINRKFIDFMQKFATEHYKTFDKNHIRDITDSLIQHSQEKRVDENSNVQLSNQKIVNIVNDLFGAGFDTITTALSWSLMYLVAHPNIQEKIQDELDRVIGKERRPRLSDRAQLPYTEAFIFEMFRHSSFMPFTIPHCTTKDTVLNGYFIPKGICVLVNQWQVNHDPNLWKDPSKFYPERFLNTDGTMVNKTEMEKVMVFGLGKRRCVGEAIGRMEVFLFLTTMLQQMQFFKQDGEKLDMSPQYGLTMKHKRCHVTAKLRFPLLTTD

SEQ ID NO: 24266 - protein, 248 aa, Geodia cydonium
MSEAPEPSPLTTKARIAEQAERYEDMAKFMKEVTEKATEELSPDDRNLLSVAYKNVVGTRRSSWRVISSIEQKSSDENKKEMAKAYREKIEKELDEICNEVLTLLDDHLLKKATSDESKVFYQKMKGDYYRYLAEVTPSGDKREDVVVKAKDSYNKALEVATEKMPPTHPIRLGLALNFSVFHYEIQNAPEKACEMAKKAFDEAIAELDNLKEDSYKDSTLIMQLLRDNLTLWTSEGQTEEQEDGGDN

SEQ ID NO: 24267 - protein, 271 aa, Nicotiana tabacum
MEDYLKQFVEETSFYNRLVLGTFMPESWWGPLPHMLQGWLRNYIGGVLLYFISGFLWCFYIYHLKRNVYIPKDAIPSNKAMLLQISVAMKAMPWYCALPSLSEYMIENGWTKCFARISDVGWLSYVIYAAIYLVIVEFGIYWMHMELHDIKPLYKYLHATHHIYNKQNTLSPFAGLAFHPLDGILQAVPHVVALLLVPMHFSTHIALIFLEALWTANIHDCIHGKVFPVMGAGYHTIHHRTYRHNYGHYTIWMDWMFGTLRDPVEEDAKKM

SEQ ID NO: 24268 - protein, 216 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGV

SEQ ID NO: 24269 - protein, 213 aa, Gossypium hirsutum
YWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 24270 - protein, 218 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 24271 - protein, 495 aa, Gracilaria gracilis
MNRDSRSLQDFKGVMDKSAASTVAEKLTVMNQMAANELEKMTDSETTGFVELYGRYMSERSKKAEIKWDLIEQPSENMLQKYDTLPKPATDEELASLLSKLAVLKLNGGLGTSMGCKGPKSVIEVRDDTTFLDLIVQQIGQLNKNHPTANVPLLLMNSFNTDSETAKIIRKYQDTSVTLTTFQQSRYPRIVKESLEPMPLTHDHYAHEDWYPPGHGDFFQSIYNSGLVDTLLAQGKEYIFVSNVDNLGATVDLNILKNVVDREVEYCMELTDKTRADIKGGTIISYDGKVSLLEVAQVPAKYVEEFKSISKFKVFNTNNIWVSLRAIKRVMQSGEMKLDIIVNNKEVKGTKVIQLESAIGAAIGYFNNACGVNVPRSRFLPVKSTSDLMLIQSNMYNLKSGSLVMNPARQFTTTPVIKLGKEFKKVAQYLERLGSIPDILELDHLTVSGDVYFGANTTLKGTVIVVANPGNTIMIPEGSVLENKVVLGSLHVIPH

SEQ ID NO: 24272 - protein, 633 aa, Phalaenopsis cv. 'KCbutterfly'
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEGIGKGCTTIFIVKLGISEDPAHRYQHKLLPPIRAGQSEADAFGSKRMPTDLIPLKNRYQRSL

SEQ ID NO: 24273 - protein, 152 aa, Arabidopsis thaliana
MGTKLQRRFCDFTISLYHQGFLDDQFTELKKLQDECSPDFVAEVVTLFFEDCEKLISNMARALDQTGNVDFKLVGSSVHQLKGSSSSVGAKRVKGLCVTLKECCDSQNYEGCVRCLQQVDIEYKTLKAKLQDLFNLEQQIVQAGGRIPQVDI

SEQ ID NO: 24274 - protein, 398 aa, Schizosaccharomyces pombe
MKEFPGLKSRNEEIRNKAANDLYEYVIAYSRELSGEALVQFNNDVNKYVYTLIHSTDPLDRLAGVTAINRLIDYEGEDTTRITRFANYLRIILPGTDQKATVLAAKALGRLAVPGGALTSEFVNFEVKRALEWLQGERNENRRYAAVLILKELAKNTSTLIYAHIDSIFELLWHGLRDPKVTIRIASADALSEFLKIVRQRDSSIRLQWYTSILNEAQRGVAQGSSDYIHGSLLVYRQLFLKAGMFMHERYREVSDIILQFRDHKDLLIRKTVTELIATLAAYNPDEFVSNYLHVCMLHLLNLLKKENVKMLAFATIGKVAVAITNSIIPYLDPICDSIKESLKIHIRNKSASDAAIFQCISLLSIALGQAFSNYAYDLFDLIFASGLSEASYRALSD

SEQ ID NO: 24275 - protein, 247 aa, Bacillus megaterium
MTTLQGKVAIVTGGSKGIGAAITRELASNGVKVAVNYNSSKESAEAIVKEIKDNGGEAIAVQADVSYVDQAKHLIEETKAAFGQLDILVNNAGITRDRSFKKLGEEDWKKVIDVNLHSVYNTTSAALTHLLESEGGRVINISSIIGQAGGFGQTNYSAAKAGMLGFTKSLALELAKTGVTVNAICPGFIETEMVMAIPEDVRAKIVAKIPTRRLGHAEEIARGVVYLAKDGAYITGQQLNINGGLYM

SEQ ID NO: 24276 - protein, 511 aa, Escherichia coli
MQSVTLCIMPRQYLLTTLVEILPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAEAKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 24277 - protein, 261 aa, Passiflora edulis
VLNHGIPNEFMDTVERMTKAHYNKCMEQRFNELVASKALEGVQVELKDMDWESTFYIRHLPESNIAEIPDLDDEYRKVMKDFAAKLEKLAEELLDLFCENLGLEKGYLKKALYGSRGPTFGSKVSNYPPCPKPELVKGLRPHTDAGGIVLLFQDGKVGGLQLLKDGQWVDVPPIPHAIVINIGDQLEVITNGKYKSVDHRVVAQTDGARMSLASFFNPGSDAVIYPAPALVEKEAEEKKQLYPKFVFEDYMKIYAGLKFHA

SEQ ID NO: 24278 - protein, 637 aa, Passiflora edulis
MDSCDCIDTQWAHEGGILVKYQYISDVLIAFAYFSIPIELIYFVQKSAFFPYRWVLMQFGAFIVLCGATHFINLWTFSMHSKAVAVVMTVAKVSCAIVSCATALMLVHIIPDLLSVKTRELFLKNKAEELDREMGLILTQEETGRHVRMLTHEIRSTLDRHTILKTTLVELGRTLGLEECALWMPSRAGSTLQLSHTLNYQAQIGSSVSINIPEVNQVFNSARAMRIPYTCPLARIRPLVGRYLPPEVVALRVPLLHLSNFQINDWPDFSARSYAVMVLILPTDSARTWREHELELVEVVADQVAVALSHAAILEESMRARDQLMEQNVALKSARREAEMAIHARNDFLAVMNHEMRTPMHAIIALSSLLLETELTPEQRAMIETVLKSSNLLATLTNDVLDLSRLEDGSLELDVAMFNLHDIFREVINLIKPIASVKKLALTLTTTPDPPSFAVGDEKRLMQTILNVVGNAVKFTKEGSVSIIASVAKPDSLRDWRPPEFYPISTDGHFYLRIQVKDSGCGILPQDIPLLFTKFIRPQSGSNRGSSGAGLGLAICKRFVSLMGGHIWIESEGLNKGTVVTFIIKLGLCTNPEDLSMLQAASRRRANHGSVDLKGHKLLFRDNDGVPPPNPRYQRSF

SEQ ID NO: 24279 - protein, 725 aa, Trypanosoma cruzi
MGLCTSKCNVEDKMCRYAPAAERLVDDFFAQDNEFLGDAGAFFACMWGASRDILLCSGDEATAFLRRACFSNPKSEEALNLYLSSSNFGRALWDLNRAKFMMIWMKYDADNSGDISLRELGKLVKGLNFPADLSKQLIAAVKAAGGIVNYAFLEKEYFLLTRLKELEYVFTGVAGPVRETITRDEFKSFLRNYQGEELNGERVKEILDYVCCMKTGEVYFTNFLKFLEDNRFCSIVDEEKVSKVYQDMNQPICNYFINSSHNTYLTGDQLTSNSSADMYRKALLDGCRCVELDCWDGFAGEPIVYHGHTRTSKISFLSCIKVIKEYAFKASEYPVILSIEVHTSSAQADRMAEIMCDTFGDMLFQSPWAPAEPTTFLFSPENLKRKILVKSKRVATSSAISDAEITENEEEEENDEEEETEGEEKELTTSGPNPLYRQFKEEKKKEEKKKEKKKKIKVALEKLSRVVSIESAGFKGTSDMSYLEKRQPYQCTSFVESKAKKIAVSNAMEFKLINQHCLSRIYPAGSRVGSSNYNPQLFWNCGCQIVALNWQSTHTYAWRLNKGFFSDNGNCGYVLKPESVRSSAASRNGSQVRSLNLEIISGFCLPKPKRSNKGEIVDPFITCFIEGPDGNSDRKTSGTIRNNGFHPVWRGKGLGTEFSWDVKDWDLSTLVVQVYDEDKKTRDDFLAECILPLRVLKAGIRQIPLHDINGNSIFGSFLTCSLTFS

SEQ ID NO: 24280 - protein, 300 aa, Antirrhinum majus
MEQPNNDGNNGGSCYRPQLPNQSPPANGVPNSTTTNSTHSPPNESVKRKRGRPRKYGTPEQAAAAKRLSAPKKRDSASGVASVSSASSKKSPLAALGNMGQSFSPHIITVAAGEDVGQKIMMFVQQSKREICVISASGSVSSASLRQQASSGGSVTYEGRFDILSLSGSFIHAEFGGRTGGLSVCLSSSDGQIIGGGVGGPLTAAATIQVIVGTFVVETKKDANVEAAASGKSPSPNGGASAPGLSFRSPADSGIQMGGGGNPFLIQNRTMHMTPMEWIGSADHGMHQSPENGDYDHIPD

SEQ ID NO: 24281 - protein, 374 aa, Alligator mississippiensis
STAGKVIKCKAAITWEIKKPFSIEEIEVAPPKAHEVRIKILATGICRSDDHVTAGLLTMPLPMILGHEAAGVVESTGEGVTSLKPGDKVIPLFVPQCGECMPCLKSNGNLCIRNDLGSPSGLMADGTSRFTCKGKDIHHFIGTSTFTEYTVVHETAVARIDAAAPLEKVCLIGCGFSTGYGAAVKDAKVEPGSTCAVFGLGGVGLSTIMGCKAAGASRIIGIDINKDKFAKAKELGATECINPLDCKKPIQEVLSEMTGGGVDYSFEVIGRIDTMTAALACCQDNYGTSVIVGVPPASEKITFNPMMLFTGRTWKGSVFGGWKSKESVPKLVADYMEKKINLDGLITHTLPFDKINEGFELLRTGKSIRSVLTF

SEQ ID NO: 24282 - protein, 375 aa, Oryctolagus cuniculus
MSTAGKVIKCKAAVLWQLNKPFSIEEVEVAPPKAHEVRIKMVATGICRSDDHAVTGSIAVPLPVILGHEAAGIVESIGEGVTTVKPGDKVIPLFTPQCGKCRICKHPESNFCLINDLGKPKGMLLDGTSRFTCKGKPIHHFIGTSTFSQYTVVDEIAVAKIDAAAPLEKVCLIGCGFSTGYGSAVKVAKVTPGSTCAVFGLGGVGLSVIMGCKAAGASRIIAVDINKDKFPKAKEVGATECINPQDYKKPIQEVIQEISDGGVDFSFEVIGRLDTVVAALLSCHGACGTSVIVGVPPDSQSLTVNPMLLLSGRTWKGAIFGGFKSKDSVPKLVADFMAKKFSLDPLITNVLPFEKINEGFDLLRSGKSIRTILTF

SEQ ID NO: 24283 - protein, 194 aa, Vigna radiata var. radiata
MAKEGLGLEITELRLGLPDAEHVAVANKNGEKKNKRVFSEIDDVGDENSSSGGGGDRKMENKNQVVGWPPVCSYRKKNSVNEASKMYVKVSMDGAPFLRKMDLGMHKGYSDLAFALEKLFGCYGMVEALKNVENGEHVPIYEDKDGDWMLVGDVPWEMFMESCKRLRIMKRADAKGFGLQPKGSLKGFIESVGK

SEQ ID NO: 24284 - protein, 196 aa, Vigna radiata var. radiata
MESRVVFESDLNLKATELRLGLPGTEEKEDNNLRTHAVLRNNKRQVRETSQDSVSISKASHHQQHVETVSAPPPKAKIVGWPPIRSYRKNSVQEGEGDGIFVKVSMDGAPYLRKVDLKVYGGYPELLKALETMFKLAIGEYSEREGYKGSEYAPTYEDKDGDWMLVGDVPWDMFVTSCKRLRIMKGSEARGLGCVV

SEQ ID NO: 24285 - protein, 427 aa, Saccharomyces cerevisiae
MHHNSQSLSSGHIRSPEDENVAPIGNLKHRTGSLSHISSAHPRVALSRVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 24286 - protein, 488 aa, Pseudomonas sp.
MSSRESASRRPDPLRVTIMQSPSAFSLTIGGHGVATSDYLPVLNPATRQPIGQCPVASEEHVEQARAAAGDAFAVWRQVPYGKRCEQLQALAGILEAHLDELAQLLTHEQGKPLADARGELAGAIAFCQCAGSLPLPEVVHEQSATRLSKTVREPLGVVVAIVPWNYPVSIAFVKPDRRVGCRKHADSQAGADHAADYLRIGELIRDALPAGVINVLAGNDDLGPWLTGHADVAKISFTGSSVTGRHVARSAAADLKRLTLELGGNDAAVVMADSLSDAVVERVFWSAFTNAGQICMATKRLYIHESIYEAFRDKLVAYAQNVVIGDGSQPGVTMGPLQNAKQFAKVMSLIDAVRQRGGRLIECGQMRGGDGYFLPITFVDLPDESAPEVVEEAFGPLLPLLKFRDVDEVIERVNAARTGWLAASGVVIGRSAHGLQQPSTRSVWSTTGCDHAVYSFGGMKASGYGAESGLEGLLEFTTQKTVIIQQQ

SEQ ID NO: 24287 - protein, 215 aa, Antirrhinum majus
MGRGKIEIKRIENSSNRQVTYSKRRNGIMKKAKEISVLCDAHVSVIIFASSGKMHEFCSPSTTLVDMLDHYHKLSGKRLWDPKHEHLDNEINRVKKENDSMQIELRHLKGEDITTLNYKELMVLEDALENGTSALKNKQMEFVRMMRKHNEMVEEENQSLQFKLRQMHLDPMNDNVMESQAVYDHHHHQNIADYEAQMPFAFRVQPMQPNLQERF

SEQ ID NO: 24288 - protein, 209 aa, Nicotiana tabacum
MGRGKIEIKRIENSSNRQVTYSKRRNGILKKAKEISVLCDARVSVIIFASSGKMHEFSSTSLVDILDQYHKLTGRRLWDAKHENLDNEINKVKKDNDNMQIELRHLKGEDITSLNHRELMMLEDALDNGLTSIRNKQNDLLRMMRKKTQSMEEEQDQLNWQLRQLEIASMNRNMGEIGEVFHQRENEYQTQMPFAFRVQPMQPNLQERF

SEQ ID NO: 24289 - protein, 217 aa, Silene vulgaris
MTIKVHGNPRSTATQRVLVALYEKHLEFEFVPIDMGAGGHKQPSYLALNPFGQVPALEDGEIKLFESRAITKYLAYTHDHQNEGTSLIHKEKHEMAAQLVWEEVEAHQFDPVASKLAWELVFKGIFGMQTDTTVVEENEAKLAKVLDVYEARLTESEYLGANDSFTLVDLHHLPLLGYLMGTQVKKLFEERAHVSAWCKKILARPSWEKTLALQKQA

SEQ ID NO: 24290 - protein, 302 aa, Saccharomyces cerevisiae
MNRFKQLEKLGNGTYATVYKGLNKTTGVYVALKEVKLDSEEGTPSTAIREISLMKELKHENIVRLYDVIHTENKLTLVFEFMDNDLKKYMDSRTVANTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 24291 - protein, 388 aa, Pichia norvegensis
MSAAKQLFKIVPLTPTEINFLQSLAPVVKEHGVTVTSTMYKYMFQTYPEVRSYFNMTNQKTGRQPKVLAFSLYQYILHLNDLTPISGFVNQIVLKHCGLGIKPDQYPVVGESLVQAFKMVLGEAADEHFVEVFKKAYGNLAQTLIDAEASVYKTLAWEEFKDFRVTKLVKEAEDVTSVYLTPVDGFKLKPIIPGEYISFRWDIHNPDITDIQPREYSISQDVKENEYRISVRDIGIVSDYINKKLQVGDIVPVHAPVGTMKYDSISKKGKVAVLAGGIGITPMIPIIEHALKDGKDVELYYSNRSYQSEPFREFFSNLEKENNGKFKLNNYISAENQKLQVKDLEHINPDEYDVYLLGPVAYMHEFKTYLVGKGVSDLKMEFFGPTDP

SEQ ID NO: 24292 - protein, 801 aa, Dictyostelium discoideum
MDTLTNSQDYSNVDLSLESLAEELYNIQSFNKDVILDSFDIDDYDHTQLDTTIDFNKFKIGLTILKISSKGKPQKKKLIFDLARNQIVCGKKKKVNFSEIDEIRVGHKTNIFNQFKSSKNLKEDIESIQQSFSILFSGNLRKTMDFVCSDIPERRQIVSALYHVVQESKSVNNEYNFVKREWDRVGKDSIDFSTLKKILARLNFTTSDAVLHNLMKFSDSNSDYHLDFSEFSNLLKLLRSHPEMKPVFYKYNGGNGEWVPIQGMIDFFRIEQSEVWTVEQCRDLIKKYHHERLDCISFENFEEFICGEANLAQYPHTSTVYQDTSKPLSYYFINSSHNTYLSGHQLKGLSTSEMYTNTLRQGCKCVELDVWDGNDGDPIIFHGNTLTSQIKFSHVCETIKARGFETSPYPVILSLEVHCSVPQQIMMANHMKEIFGEMLPTPLPEGTKELPTLDSLKYKILLKGHTSHTHVSAVGNSSASSSQSNIQTDDNDDDGAVDLTEYDEVDDRSASSSSSSFSLSFGSSGKKKKITKIKIAPEFEELIYLVSHGFKSGNTTKEIPSYKIHSLVEEKVKQLVQSEPREVVEASQNHLLRVYPRGTRFDSSNFDPMPGWSIGCQLAALNQQTSSEPMWINDGMFSDNGGCGYVLKPPCLLPGECETYDPTSPERIKSSKYSRLIVNVISARQLPKYTKSTKGEVIDPYVTLSIVGTHFDQKVEKTKVIDNNGFNPHWGEEFEFPLYNSQLSMLLIRVDDKDKVGHNRIGHHCIRVENIRPGYRILKLKNNFNRTIPLANLLCKFTFVE

SEQ ID NO: 24293 - protein, 485 aa, Petroselinum crispum
MALSVEKTAAGREYKVKDMSLADFGRLELELAEVEMPGLMSCRTEFGPSQPFKGARITGSLHMTIQTGVLIETLTALGAEVRWCSCNIFSTQDHAAAAIARDSCAVFAWKGETLQEYWWCTERALDWGPDGGPDLIVDDGGDATLLIHEGVKAEEEYKKSGAIPDPASTDNAEFQIVLSIIRDGLKSDPMKYHKMKDRLVGVSEETTTGVKRLYQMQQNGTLLFPAINVNDSVTKSKFDNLYGCRHSLPDGLMRATDVMIAGKVALIAGYGDVGKGCAAAMKQAGARVIVTEIDPICALQATMEGLQVLPLEDVVSEVDIFVTTTGNKDIIMVSDMRKMKNNAIVCNIGHFDNEIDMLGLETYPGVKRITIKPQTDRWVFPDTGRGIIILAEGRLMNLGCATGHPSFVMSCSFTNQVIAQLELWNEKSSGKYEKKVYVLPKHLDEKVAALHLGKLGAKLTKLSKDQADYISVPVEGPYKPAHYRY

SEQ ID NO: 24294 - protein, 485 aa, Triticum aestivum
MALSVEKTSSGREYKVKDLFQADFGRLELELAEVEMPGLMACRTEFGPSQPFKGARISGSLHMTIQTAVLIETLTALGAEVRWCSCNIFSSQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDASKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKASGKYEKKVYVLPKHLDEKVAALHLGKLGARLTKLTKSQSDYISIPIEGPYKLRLYRY

SEQ ID NO: 24295 - protein, 319 aa, Pseudomonas sp.
MPRREMMKCLFVSESCVCHTDLAIKDGVLPFPLPAVLGHEGSGIVEAVGPGVKHLKPGDAVVMTFASCGHCASCEHERPSYCLDFGAQNYSAQRADGPVLLSQGDEVISGFFFGQSSFSSMAMAREHNLVKIDALVDDAPIELLGPLGCGVQTGAGAVMISLDVRAGRSFLVLGGGAVGLSAVMAAKLRGCSRIIVSEPSAAKREQALALGATEVIDPLNENLVERVQQITEGQGCDYALECTGLVSVMEQAIDSMAMRGQLAVVGVPPKLDATAAVSPLALIQKGLKLMGVIEGDSCRVYSSTSCTRSSRLGVFRSPR

SEQ ID NO: 24296 - protein, 143 aa, Corynebacterium diphtheriae
MYQQLGREATNEELAEESGIEESKIEMLLRQSRDPVSLDMPVGADEEAPLGDFIEDSEATDAESAVVASLRHSDIRTVLDTLEQREQDVIRLRYGLDDGVPRTLDQIGRQFGLSRERVRQIEREVMSKLRDGARAEKLRAYAQ

SEQ ID NO: 24297 - protein, 324 aa, Paramecium tetraurelia
MIIENQRCFGKEIANSTLHQSKEIGIIVEKHKKPFSIIPKVFAMSLDDKENKLFRRESEKFQIEIETEKSKDVKNPQNVELYSNEILQHLLIEENKYTINQYMTPEQQPDINIKMRAILVDWLIDVHAKFELKDETLYITISLIDRYLALAQVTRMRLQLVGVAALFIACKYEEIYPPALKDFVYITDNAYVKSDVLEMEGLMLQALNFNICNPTAYQFLQKYSTNLDPKDKALAQYILELALVEYKFIIYKPSQIVQSVIFLVNKIRTPTYKTPNENQLKPCAKELCTLLQTADLSSLQAVRKKFNASKFFEVSRIKVEKTNK

SEQ ID NO: 24298 - protein, 336 aa, Paramecium tetraurelia
MIHEQYRFFGKELVNSSGEFQKENTDRNKPKHLTVLPRYLKLNLWQEEKENKMEVENNTQQLCSFDQQMIKDPQYTSLYNKEIYTYLLTQEEKYLVSNNYMNEQQQPDLNARMRAILLDWLIDVHLKFKLRDETLYVTTYLIDRFLNFKTTTRQQLQLVGVASLFIACKYEEIYPPDLKDFVYITDNAYTKQDVLEMEGQILQTLDFSITQPSSYCFLQRFGRIAGLDTKNLSLAQYLLELSIVDIKFMNYKPSFLSAAAIYLVHKIRKTPQSWSEEMQKMTGYNEQELRYCAKEMCLVLQSSDKSNLQAVRKKFAQPKYQEVSRIRVERQIKQQK

SEQ ID NO: 24299 - protein, 311 aa, Leishmania major
MSSFGRVTARSGDAGTRDSLDRYNRLDVLGEGTYGVVYRAVDKITGQYVALKKVRLDRTEEGIPQTALREVSILQEFDHPNIVNLLDVICSDGKLYLVFEYVEADLKKAIEKQEGGYSGMDLKRLIYQLLDGLYFCHRHRIIHRDLKPANILLTSGNVLKLADFGLARAFQVPMHTYTHEVVTLWYRAPEILLGEKHYTPAVDMWSVGCIFAELTRRKVLFRGDSEIGQLFEIFQVLGTPTDTEGSWPGVSRLPDYRDVFPKWTAKRLGQVLPELHPDAIDLLSKMLKYDPRERISAKEALQHPWFSDLRW

SEQ ID NO: 24300 - protein, 362 aa, Escherichia coli
MFRQGITGRSHLMSQNTLKVHDLNEDAEFDENGVEVFDEKPLVEQEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAVEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALLPRVSKHLSERPVSSEAGFFCAQ

SEQ ID NO: 24301 - protein, 377 aa, Escherichia coli
MFRQGITGRSHLMSQNTLKVHDLNEDAEFDENGVEVLDEKALVEQEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEAPFARNPANAGAEYRSAVPRVSKHLSERPVSSEAGLFCAQ

SEQ ID NO: 24302 - protein, 725 aa, Trypanosoma cruzi
MGLCTSKCNVEDKMCRYAPAAKRLVDDFFAQDNEFLGDAGAFFACMWGASRDILLCSGDEATAFLRRACFSNPKSEEALNLYLSSSNFGRALWDLNRAKFMMIWMKYDADNSGDISLRELGKLVKGLNFPADLSKQLIAAVKAAGGIVNYAFLEKEYFLLTRLKELEYVFTGVAGPVRETITRDEFKSFLRNYQGEELNGERVKEILDYVCCMKTGEVYFTNFLKFLEDNRFCSIVDEEKVSKVYQDMNQPICNYFINSSHNTYLTGDQLTSNSSADMYRKALFDGCRCVELDCWDGFAGEPIVYHGHTRTSKISFLSCIKVIKEYAFKASEYPVILSIEVHTSSAQADRMAEIMCDTFGDMLFQSPWAPAEPTTFLFSPENLKRKILVKSKRVATSSAISDAEITENEEEEENDEEEETEGEEKELTTSGPNPLYRQFKEEKKKEEKKKEKKKKIKVALEKLSRVVSIESAGFKGTSDMSYLEKRQPYQCTSFVESKAKKIAVSNAMEFKLINQHCLSRIYPAGSRVGSSNYNPQLFWNCGCQIVALNWQSTHTYAWRLNKGFFSDNGNCGYVLKPESVRSSAASRNGSQVRSLNLEIISGFCLPKPKRSNKGEIVDPFITCFIEGPDGNSDRKTSGTIRNNGFHPVWRGKGLGSEFSWDVKDWDLSTLVVQVYDEDKKTRDDFLAECILPLRVLKAGIRQIPLHDINGNSIFGSFLTCSLTFS

SEQ ID NO: 24303 - protein, 342 aa, Escherichia coli
MFRQGITGRSHLMSQNTLKVHDLNEDAEFDENGVEVLDEKALVEQEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 24304 - protein, 571 aa, Chlamydia trachomatis
  unsure (1)..(571): unsure at all Xaa locations
MRIHTLDSQRADAAQEEEIQRKLEELVTLAKDQGFITYEEINEILPPSFDSPEQIDQVLIFLAGMDVQVLNQADVERQKERKKEAKELEGLAKRSEGTPDDPVRMYLKEMGTVPLLTREEEVEISKRIEKAQVQIERIILRFRYSTKEAVSIAQYLINGKERFDKIVSXKEVEDKTHFLNLLPKLISLLKEEDSYLEERLLALKDPALSKQDQAKLNDELEKCRIRTQAYLRCFHCRHNVTEDFGEVVFKAYDSFLQLEQQINDLKVRAERNKFAAAKLAAARRKLYKREVAAGRTLEEFKKDVRMLQRWMDKSQEAKQEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELGEELGFTPDRVREIYKIAQHPISLQAEVGDSGESSFGDFLEDTAVESPAEATGYSMLKDKMKKVLKTLTDRERFVLIHRFGLLDGRPKTLEEVGSAFNVTRERIRQIEAKALRKMRHPIRSKQLRAFLDLLEEEKTGSGKIKSYKN

SEQ ID NO: 24305 - protein, 684 aa, Agrobacterium tumefaciens
MATKVKENEEAENERDGATDGPLLDLSDDAVKKMIKAAKKRGYVTMDELNSVLPSEEVTSEQIEDTMAMLSDMGINVIEDEDAEEAAPAEDDGDSDNEESEGGELAPSGGTALATAKKKEPTDRTDDPVRMYLREMGSVELLSREGQIAIAKRIEAGRETMISGLCESPLTFQALIIWRDELNEGTTLVREIIDLETTYSGPEAKAAPQFQSPEKIEADRKAAEEKEKTRRLRGPTGDEDVTDVGGDGLPPEEEEEDDDESNLSLAAMEAELRPQVMETLDTIADTYKNVRKLQDQQVEARLACTGTLSSGQERRYKELKDQLITAVKSLSLNQNRIDSLVEQLYDISKRLMQNEGRLLRLAESYGVKRDSFLEQYHGAELDPNWMKSITNLAARGWKEFAREESNTIREIRQEIQNLSTETGISIAEFRRIVSMVQKGEREARIAKKEMVEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPVGDEEDSHLGDFIEDKNALLPIDAAIQGFLRETTTRVLASLTPSEERVLRMPFGIGMNTDHTLEEVGQQFSVTRERIRQIEAKALRNVKHPSRSRKLRTFLDS

SEQ ID NO: 24306 - protein, 375 aa, Papio hamadryas
MSTAGKVIKCKAAVLWEVKKPFSIEEVEVAPPKAHEVRIKMVAVGICRSDDHVVSGTLVTPLPAILGHEAAGIVEGVGEGVTTVKPGDKVIPLFTPQCGKCRVCKNPESNYCFKNDLSNPRGTMQDGTRRFTCGGKPIHHFLGISTFSQYTVVDENAVAKIDAASPLEKVCLIGCGFSTGYGPAVKVAKVTPGSTCAVFGLGGVGLSAVMGCKAAGAARIIAVDINKDKFAKAKELGATECINPQDYKKPIQEVLKEMTDGGVDFSFEVIGRLDTIMASLLCCHEACGTSVIVGVPPDSQNLSINPVLLLTGRTWKGAIFGGFKSKESVPKLVSDFMAKKFSLDALITNVLPFEKINEGFDLLRSGKSIRTILMF

SEQ ID NO: 24307 - protein, 370 aa, Pneumocystis carinii
MDSKHSVFNVMGQEFVLQKGYEVIKGLGKGSYGVVCSAKNIEVEDNNKVAIKKITNIFSKKMLAKRALREIMLLQHFRNHKNITTLYDMDIVDPSKFNELYLYEELMQANLNSIIRSDQPLTDAHFQSFIYQILCGLKYIHSANVLHRDLKPSNLLINADCKLKICDFGLSRGISVNQGQGTEYMTEYVTTRWYRAPEVMLSFQSYSKAIDLWSVGCILAELLGRKPFFKGSNYVDQLNQIFCILGTPNENIISKIKSASAQSYIRSLPTLPKMPYSKIFPYANPDALDLLNCLLTFDPYDRISCEEALEHPYLIIWHDPNKEPVCSEQFDFGFEAIDSIEEIRQMIINEVSRFKGLTGNQKLYHSISNT

SEQ ID NO: 24308 - protein, 393 aa, Streptomyces aureofaciens
MQTQTLTVNVSRPVSDTAGASGTARTAAAPEARRTDEPVDEAVDEAADPAARAAGDETAEDEGPDEGPEVLELIEHVPPPRTRGAESGGAGPSADLFRQYLREIGRIPLLTAAEEVDLARRVEAGLFAEEKLGGAADLDSQLAVDLDRLVVMGRMAKRRLIESNLRLVVSVAKRYVGRGLTMLDLVQEGNLGLIRAVEKFDYARGYKFSTYATWWIRQAMSRALADQARTIRVPVHVVELINRVVRVQRRMLQERGYEPTAEEVAVHLELTPERVLEVLRLAQEPVSLHAPVGEEDDVALGDLIEDGDAASPVESAAFFLRCEHLEAVLSTLGERERKVVQLRYGLADGRPRTLEEIGRIFGVTRERIRQIESKTLNKLRDHAFADQLRGYLD

SEQ ID NO: 24309 - protein, 525 aa, Streptomyces aureofaciens
MSASTSRTLPPEIADSESVMALIERGKAEGQIAGDDVRRAFEADQIPATQWKNVLRSLNQILEEEGVTLMVSAAESPRRTPRKSVAAKSPAKRTATKTVAAKTAAPPAAAGIVADTGTGTAEPDITDALAEEPVAEPAAKKTAARKTAAKKAAPAKKTAAKKTAAKKTAAKKDADEDGEETADEGPDAPKAEAEEEEEGGENKGFVISDDEDDAPAQQVVVAGATADPVKDYLKQIGKVPLLNAEQEVELAKRIEAGLFAEDKLANSDKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 24310 - protein, 325 aa, Streptomyces aureofaciens
MATRAVARRQSTSSARAVGGEIADRDLVGMYLDEIARTPLLDAAKEVELSQIIEAGVYARQILDEATPREGESPAREELEALAAEGERAKEVFIRSNLRLVVAVVRRYPRSGLPLLDLIQEGNAGLVRAVEKFDYAKGFKFSTYATWWIRQAITRSIADQSRTIRLPVHLVEELGRIRRVQREFNRENGRDPEHAEIAAELDSTEKRVGDVLDWARDPVSLNMSVDDEGDTQFGDLLEDTSAISPEQSVLSLLRSEELEDLLGKLDQRTASIIKMRYGIEDGRERTLTEVGKQHGLTRERIRQIEKHALLELKRMARDTGFDAVA

SEQ ID NO: 24311 - protein, 528 aa, Streptomyces aureofaciens
MSLSPSRTFPPEIAESEALVALVERGREQGHINGDDVRQAFEAGRIPVDQWKRVLRSLNQVLDEEGVALHVSAAPATKAAAKKPRKAAAAPARTVTKKAAAPPRPIGARKTSAAAPAAAAAISAPSAAATGDEATAEAAAEPKKRTVKKTAAKKATATKKTAATKKAGAKDGDDAENPAVEGEDWAVEDLADEAEEETPKAGGTQGFVLSDDDEDDAPAQTVMVAGATADPVKDYLKLIGKVPLLNAEQEVELAKRIEAGLFSEYKLEEEEDHKPAFKRELEILVEDGRRAKNHLLEANLRLVVSLAKRYTGRGMLFLDLIQEGNVGLIRAVEKFDYTKGFKFSTYATWWIRQAITRAMADQSRTIRIPVHMVEIINKLARVQRQMLQDLGREPTPEELGKELDMTPEKVIEVQKYGREPISLHTPLGEEGDSEFGDLIEDSEAVVPADAVSFTFLQEQLQSILGTLSEREAGVVSMRYGLNDGQPKTLDEIGRVYGVTRERIRQIESKTMSKLRHPSRSQVLRGYLD

SEQ ID NO: 24312 - protein, 333 aa, Arabidopsis thaliana
MSKARVYTEVNVIRPKDYWDYESLIVQWGEQDDYEVVRKVGRGKYSEVFEGINVNSKEKCIIKILKPVKKKKIRREIKILQNLCGGPNIVKLLDVVRDQHSKTPSLIFEYVNSTDFKVLYPTLTDYDIRYYIYELLKALDFCHSQGLMHRDVKPHNVMIDHELRKLRLIDWGLAEFYHPGKEYNVRVVSRYFKGPELLVDLQDYDYSLDMWSLGCMFAGLLFRKEPFFYGHDNQDQLVKIAKGVGTDELNAYLNKYQLELDPQLEALVGRHSRKPWSKFINADNQHLVSPEAIDFLDKLLRYDHQDRLTAKEAMAHAYFAQVRAAETSRMRSQ

SEQ ID NO: 24313 - protein, 333 aa, Arabidopsis thaliana
MSKARVYTDVNVIRPKDYWDYESLNVQWGEQDDYEVVRKVGRGKYSEVFEGINMNNNEKCIIKILKPVKKKEIRREIKILQNLCGGPNIVKLLDVVRDQHSKTPSLIFEYVNSTDFKVLYPTLTDYDIRYYIYELLKALDFCHSQGIMHRDVKPHNVMIDHGLRKLRLIDWGLAEFYHPGKEYNVRVASRYFKGPELLVDLQDYDYSLDMWSLGCMFAGMIFRKEPFFYGHDNQDQLVKIAKVLGTDELNAYLNKYQLELDTQLEALVGRHSRKPWSKFINADNRHLVSPEAIDYLDKLLRYDHQDRLTAKEAMAHPYFAQVRAAESSRMRTQ

SEQ ID NO: 24314 - protein, 609 aa, Caenorhabditis elegans
FNLMKPISKWCPDSSLLIIVGLALGWILHQTSLSGATLDSHTFFLYLLPPIIFGSSGYFMPNRALFENFDSVLVFSVFGTIWNTFAIGGSLLLMAQYDLFTMSFTTFEILVFSALISAVDPVAVIAVFEEIHVNEFLFINVFGEALFNDGVTVVLYQCSKFALIGSENLSVLDYATGGLSFFVVALGGAAVGIIFAIAASLTTKYTYDVRILAPVFIFVLPYMAYLTAEMVSLSSIIAIAICGMLMKQYIKGNVTQAAANSVKYFTKMLAQSSETVIFMFLGLSTISSQHHFDLYFICATLFFCLIYRAIGIVVQCYILNRFRAKKFEMVDQFIMSYGGLRGAIAYGLVVSIPASITRKPMFITATIAWIYFTVFLQGITIRPLVNFLKIKKKEERDPTMVESVYNKYLDYMMSGVEDIAGQKGHYTFIENFERFNAKVIKPVLMRHQKRESFDASSIVRAYEKITLEDAIKLAKVKNNIQNKRLERIKSKGRVAPILPDKISNQKTMTPKDLQLKRFMESGENIDSLYTLFSDLLDRKLHEMNRPSVQITDVDGQDDIQDDYMAEVSRSNLSAMFRSTEQLPSETPFHSGRRQSTGDLNATRRADFNV

SEQ ID NO: 24315 - protein, 523 aa, Homo sapiens
MKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGNIMSMHNVKLFLYQILRGLAYCHRRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPSQETWPGISSNEEFKNYNFPKYKPQPLINHAPRLDSEGIELIRKFLQYESKKRVSAEEAMKHVYFRSLGPRIHALPESVSIFSLKEIQLQKDPGFRNSSYPETGHGKNRRQSMLF

SEQ ID NO: 24316 - protein, 291 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKNFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 24317 - protein, 245 aa, Lolium temulentum
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRSRKSQLMHESISELQKKERSLQEENKILQKELIEKQKAHTQQAQLEQTQPQTSSSSSSFMMGEATPATNRSNPPAAASDRAEDATGQPPARTVLPPWMVSHLNNG

SEQ ID NO: 24318 - protein, 261 aa, Lolium temulentum
MGRGKVQLKRIENKINRQVTFSKRRNGLLKKAHEISVLCDAEVAVVVFSPKGKLYEYATDSSMDKILERYERYSYAEKALISAESESEGNWCHEYRKLKAKIETIQKCHKHLMGEDLECLNLKELQQLEQQLESSLKHIRSRKSHLMMESISELQKKERSLQEENKALQKELVERQKAARQQQQEQWDRQTQTQQAQNQPQAQTSSSSSSFMMRDQQAHAQQNICYPLVTMGGEAVAAAPGQQGQLRIGGLPPWMLSHLNA

SEQ ID NO: 24319 - protein, 689 aa, Didelphis virginiana
MADLEAVLADVSYLMAMEKSKATPAARASKKILLPEPSIRSVMQKYLEDRGEVTFEKIFSQKLGYLLFREFCLNHMEEAKPLVEFYDEIKKYEKLDSEEERTVKSREIFDLYIMKELLSCSHLFSKSATEHVQSRLLKKQVPTDLFQPYIEEICQRFRDDVFQKFIESEKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSESDMRFYAAEIILGLEHMHSRFVVYRDLKPANILLDEFGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRSLGCLGRGAQEVKEDPFFKAVDWQMVLLQKYPPPLIPPRGEVNAADAFDIGSFDEEDTKGIKLLDSDQELYRNFPLTISERWQQEVAETVFDTVNSETDRLEARKKAKNKQLGHEDDYALGKDCIMHGYMSKMGNPFLTQWQRRYFYLFPNRLEWRAEGEAPQSLLTMEEIQSVEETQIKDRKCILLKIRGGKQFILQCDSDPELVQWKKELRDVYREAQQLLQRVPKMKNKPRSPVVELSKMPLTQRGSANGL

SEQ ID NO: 24320 - protein, 362 aa, Rattus norvegicus
MGDSVQILLVFMDKGAGESGKSTIVKQMRILHVNGFNGEGGEEDPQAARSNSDGEKATKVQDIKNNLKEAIETIVAAMSNLVPPVELANPENQFRVDYILSVMNVPNFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 24321 - protein, 596 aa, Caulobacter vibrioides
VILPTALKSRLALEFETLPDPFRRPAARAAGLDPAHAWRLGWLAAVCLAAAAALFTADSGGWPVWAALGAGALPALVSLIFTREDERTQSWLLVLWAVGGSLAAVLTGGVGGAMAAWCLAPVAAASTQDQPKRLAEGAALALIGACVAALTQLSGLAPAAPTGPLAFVLGFLALVTTGLGLAAGLLIGRRRQGARDDRYASEIIGLETLLDGLPHLAIAVRGQGQVTAVRGAAPPGVTRADLVNRGLTGAAAPGDRQRLTAAIAQAHREGSASLTFNPALGVERVVALDMHRVAPNQLVGVLRDITVERHREHARPGAIDAEALAAGRARFLANMSHELRTPLNAIMGFSDIMRARMFGPLSDRYAEYAELIHESGGHLLDLINDVLDMSKIEAERFELQRGVFDAREAVQAAMRLLRVQSDTAGVQLRGVLPPGELEVDADRRALKQIVLNLVSNALKFTPRGGQVTVTAHGYDGVLEIVVADTGVGISPEDLERLGRPYEQAGGAEQRARGTGLGLSLVRAFAQLLGGEMVIESRLGAGTTVSVRLPVLLAPMVAATPTPPAAPEAPSAPEPAPTVEEPPPASLGDNVIAFAPR

SEQ ID NO: 24322 - protein, 295 aa, Pseudomonas putida
MAGKSPLINLNNGVKMPALGLGVFAASAEETASAIASAISSGYRLIDTARSYNNEAQVGEGIRNSVDRAEMFVTTKLFNCDYGYERALRAFDESLGRLGLDYVDLYLLHWPTKDWNATIQSWKAAEKILGDGRARAIGVCNFLEDQLDELIAASDVVPAVNQIELHPYFAQKPLLAKNRALGIVTEAWSPIGCHQRWQDGDNHGGRKHPLTDPVITTIAEAHGRSAAQVILRWHFQNDVVAIPKSVNPERIAKNIDVFDFALSDAEMAQLDELDTGVRIGPDPRDVDTSSFAEFV

SEQ ID NO: 24323 - protein, 635 aa, Solanum tuberosum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPINLPIINEIFSSPEAIQIPHTNPLARMRNTVGRYIPPEVVAVRVPLLHLSSFTNDWAELSTRSYAVMVLVLPMNGLRKWREHELELVQVVADQVAVALSHAAILEDSMRAHDQLMEQNNALDDARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQILLNVAGNAVKFTKEGHISIEASVAKPEYARDCHPPEMFPMPSDGQFYLRVQVRDTGCGISPQDIPLVFTKFAEARPTSNRSTGGEGLGLAICRRFIQLMKGNIWIESEGSGKGTTVTFVVKLGICNHPNALPLLPMPPRGRLNKGSDDLFRYRQFRGDDGGISVNAQRYQRSL

SEQ ID NO: 24324 - protein, 254 aa, Serratia marcescens
MGDLAGKKVFITGAEQGIGRATAERLIKAGCDIYFHYHSDESGPKALVALAHSLGQKAAYGYADLIDTDETLRCVSAGAEFLGGIDILINNVGGIVGRKWLGEIDRAFWQTVIDVNMTTMLNVTQSALPHLKAAPNGASIINLASLAGRAGGHAGSLVYSATKGAVLTWTRSLAAELGEHGIRVNAVAPGLILGTRFHNRHTTQASAEETVRAIPLGRAGTPDDVARAIAFLAAEYDGFISGATLDINGGIYRM

SEQ ID NO: 24325 - protein, 128 aa, Saccharomyces cerevisiae
MNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 24326 - protein, 264 aa, Gerbera hybrid cv. 'Terra Regina'
MENSDVLELDFSCVDRSMSFPDDTGDMSPQRKMGKGKIEIKRIENTTNRQVTFCKRRNGLLKKAYELSVLCDAEVALIVFSSRGRLYEYANNSVKGTIDKYKKACLDPPTSGTVAEANTQYYQQEAAKLRQQIANLQNQNRQFYRNIMGESLGDMPVKDLKNLEGKLEKAISRIRAKKNELLFAEIEYMQKRELELHNSNQFLRAKIVENERAQQHHMSLMPGSSDYELVTPHQPFDGRNYLQTNDLQPNNDYSCQDQTPLQLV

SEQ ID NO: 24327 - protein, 246 aa, Gerbera hybrid cv. 'Terra Regina'
MSFPNDSGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLESKLEKGIGKIRSKKNEILFAEIEYMQKRENELHNSNQFLRSKIAENERAQQHMSLMPGSSDYELVAPHQPFDGRNYLQVNDLQPNNNYSCQDQTPLQLV

SEQ ID NO: 24328 - protein, 226 aa, Gerbera hybrid cv. 'Terra Regina'
MGRGKIEIKKIENNTNRQVTYSKRRNGIFKKAHELTVLCDAKVSLIMFSNTGKFHEYISPSTTTKKMYDQYQSTVGFDLWSSHYERMKETMKKLKDTNNKLRREIRQRVLGEDFDGLDMNDLTSLEQHMQDSLTLVRERKYHVIKTQTDTCRKRVRNLEQRNGNLRLDYETIHQLDKKYDTGENEGDYESVVAYSNGVSNLYAFCVHPNNIPHGAGYELHDHQHTN

SEQ ID NO: 24329 - protein, 228 aa, Gerbera hybrid cv. 'Terra Regina'
MARGKIQIKKIENSTNRQVTYSKRRNGLFKKASELTVLCDAKVSIIMVSCTDKLHEYISPSITTKQFFDQYQKASGIDLWNSHYEKMQEELRQLKEVNRNLRRQIRQRLGDCLEDLGFEEFLDLEKESQEAVYIIRERKLKVIGNKLETSKKKVRSAQDVYKKLMHEFDIRGEDPQYGMIEDGVEYEALYGYPPHISAPRILTLRLQPNHPDNLHAAASDLTTYALLG

SEQ ID NO: 24330 - protein, 197 aa, Gerbera hybrid cv. 'Terra Regina'
MGRGKIEIKRIENTSNRQVTYSKRKNGIIKKAKEITVLCDANVSLVIYGSSGKMYEYCSPKTNLIDMLDRYQRLSGNKLWDAKHENLQNEIDRIKKENESMQIELRHLKGEDITSLNYEELIAYEDALENGLTNIREKKDEIPKIMRKHEQVLEEENKHLMYLVQQSEMAAMGDYQAAHEPFSFRVQPMQPNLHERM

SEQ ID NO: 24331 - protein, 520 aa, Trametes versicolor
MSRFHSLLAFVVASLAAVAHAGIGPVADLTITNAAVSPDGFSRQAVVVNGGTPGPLITGNMGDRFQLNVIDNLTDHTMLKSTSIHWHGFFQKGTNWADGPAFINQCPISSGHSFLYDFQVPDQAGTFWYHSHLSTQYCDGLRGPFVVYDPNDPAADLYDVDNDDTVITLADWYHVAAKLGPAFPLGADATLINGKGRSPSTTTADLTVISVTPGKRYRFRLVSLSCDPNHTFSIDGHNMTIIETDSINTAPLVVDSIQIFAAQRYSFVLEANQAVDNYWIRANPSFGNVGFTGGINSAILRYDGAAAIEPTTTQTTSTEPLNEVNLHPLVATAVPGSPAAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 24332 - protein, 287 aa, Triticum sp.
MVMAAAERRDAEAELNLPPGFRFHPTDEELVADYLCARAAGRAPPVPIIAELDLYRFDPWELPERALFGAREWYFFTPRDRKYPNGSRPNRAAGGGYWKATGADRPVARAGRTVGIKKALVFYHGRPSAGVKTDWIMHEYRLAGADGRAAKNGGTLRLDEWVLCRLYNKKNQWEKMQRQRQEEEAAAKAAASQSVSWGETRTPESDVDNDPFPELDSLPEFQTANASILPKEEVQELGNDDWLMGISLDDLQGPGSLMLPWDDSYAASFLSPVATMKMEQDVSPFFF

SEQ ID NO: 24333 - protein, 351 aa, Triticum sp.
MSDVTAVMDLEVEEPQLALPPGFRFHPTDEEVVTHYLTRKVLRESFSCQVITDVDLNKNEPWELPGLAKMGEKEWFFFAHKGRKYPTGTRTNRATKKGYWKATGKDKEIFRGKGRDAVLVGMKKTLVFYTGRAPSGGKTPWVMHEYRLEGELPHRLPRTAKDDWAVCRVFNKDLAARNAPQMAPAADGGMEDPLAFLDDLLIDTDLFDDADLPMLMDSPSGADDFAGASSSTCSAALPLEPDAELPVLHPQQQQSPNYFFMPATANGNLGGAEYSPYQAMGDQQAAIRRYCKPKAEVASSSALLSPSLGLDTAALAGAETSFLMPSSRSYLDLEELFRGEPLMDYSNMWKI

SEQ ID NO: 24334 - protein, 461 aa, Triticum aestivum
FAPPAASKLTVAAHRLKLSPHGRAQVMRALRQSAPALAPQPPPLLPADEFSLDAIILLQRSMLEKQWQLPFEEEDDDDGGGDGHHVEAIGSAEDDDGKGRSSSVVVARSGVSARQRRMSGRRRGRSKKGSGAVHLSISPELLQSRNRIYLRGTVSKELLTQKQVVHLSKKIKDGIWLQQQRSKLKEKLGNEPSYKQMAQSLRISTPELRSRMRESFLAREVLTMSNIRLVISIAQKYDKLGVELSDLIQGGLIGLLRGIEKFDASRGFRISTYVYWWIRQGVSRALADNSKTFRLPTYLHERLIAIRGAKYALEDQGVSPTTQNIAKLLNISEKKVHNATEAVNKALSLDQQAFPSLNGLPGDTLHSYIEDQNVANDPWHGFEEWYLKEEVNKLLNSNLTERERDIIQLYHGIGKQCHTWEDISRQFGLSRERVRQVGLIAMEKLKQRARRKKLDALLQDY

SEQ ID NO: 24335 - protein, 417 aa, Brassica napus
MAATAATTSSSHLLLSSSRHVAASSQPQILFQRSLFSGGKRSAAGKNHHASGGVRCMAVAADASAEAKPAAARKKSGYELQTLTGWLLRQEQKGEIDTELTIVMSSIAMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYSPNDECIVDDSDDISSLGSEEQRCIVNVCQPGNNLLAAGYCMYSSSVIFVLTLGKGVFSFTLDPMYGEFVLTQENIEIPKAGKIYSFNEGNYQMWDEKLKKYIDDLKDPGPSGKPYSARYIGSLVGDFHRTLLYGGIYGYPRDAKSKNGKLRLLYECAPMSFIVEQAGGKGSDGHQRVLDIQPTEIHQRVPLYIGSKEEVEKLEKYLA

SEQ ID NO: 24336 - protein, 251 aa, Hordeum vulgare
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEIKNYWNTHIKRKLLSRGMDPHTHRPLTAVIDAAAPTRPAQIAVPARAAPTTMFALPTKQQQPPVPVESSDDDGSSGATSTGEPRCPDLNLDLSVGPPAADTPTSHPVCLCRHLGFRGGEACSCRQADSAGSQGGGFRYFRPLEEGQYI

SEQ ID NO: 24337 - protein, 267 aa, Hordeum vulgare subsp. vulgare
MEAENGEVAALVEKITGLHAAISKLPALSPSPQVDALFTELVAACVPSSPVDVTKLGPEAQEMRQDLIRLCSAAEGLLEAHYSDMLTALDSPLDHLGRFPYFDNYVNLSKLEHDLLAGHWFSSLFLATYHLPDTRFDNYDRCSVANGRAMKLVGAADEGVRSRMAFHTAEVTDLTAELGAYDVVFLAALVGMTSKEKADAIAHLGKHMADGAVLRARSAHGARAFLYPVVELDDVGRGGFQVLAVHHPAGDEVFNSFIVARKVKMSA

SEQ ID NO: 24338 - protein, 320 aa, Arabidopsis thaliana
MACQNNLVVKQIIDLYDQISKLKSLKPSKNVDTLFGQLVSTCLPTDTNIDVTNMCEEVKDMRANLIKLCGEAEGYLEQHFSTILGSLQEDQNPLDHLHIFPYYSNYLKLGKLEFDLLSQHSSHVPTKIAFVGSGPMPLTSIVLAKFHLPNTTFHNFDIDSHANTLASNLVSRDPDLSKRMIFHTTDVLNATEALDQYDVVFLAALVGMDKESKVKAIEHLEKHMAPGAVLMLRRAHALRAFLYPIVDSSDLKGFQLLTIYHPTDDVVNSVVIARKLGGPTTPGVNGTRGCMFMPCNCSKIHAIMNNRGKKNMIEEFSTIE

SEQ ID NO: 24339 - protein, 320 aa, Arabidopsis thaliana
MACQNNLVVKQIMDLYNQISNLESLKPSKNVDTLFRQLVSTCLPTDTNIDVTEIHDEKVKDMRSHLIKLCGEAEGYLEQHFSAILGSFEDNPLNHLHIFPYYNNYLKLGKLEFDLLSQHTTHVPTKVAFIGSGPMPLTSIVLAKFHLPNTTFHNFDIDSHANTLASNLVSRDSDLSKRMIFHTTDVLNAKEGLDQYDVVFLAALVGMDKESKVKAIEHLEKHMAPGAVVMLRSAHGLRAFLYPIVDSCDLKGFEVLTIYHPSDDVVNSVVIARKLGGSNGARGSQIGRCVVMPCNCSKVHAILNNRGMEKNLIEEFSAIE

SEQ ID NO: 24340 - protein, 362 aa, Candida albicans
SPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPLNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 24341 - protein, 759 aa, Oncorhynchus mykiss
MPAFSCAFPRCRRDLLVIVLVVFVGIGLPIEASAPAYQSHGTEGSHLTNITNTKKAFPVLAVNYEHVRKPFEIALWILLALLMKLGFHLIPRLSAVVPESCLLIVVGLLVGGLIKVIGEEPPVLDSQLFFLCLLPPIILDAGYFLPIRPFTENVGTILVFAVIGTLWNAFFMGGLLYALCQIESVGLSGVDLLACLLFGSIVSAVDPVAVLAVFEEIHINELVHILVFGESLLNDAVTVVLYNLFEEFSKVGTVTVLDVFLGVVCFFVVSLGGVLVGAIYGFLAAFTSRFTSHTRVIEPLFVFLYSYMAYLSSEMFHLSGIMALIACGVVMRPYVEANISHKSYTTIKYFLKMWSSVSETLIFIFLGVSTVAGPHAWNWTFVITTVILCLVSRVLGVIGLTFIINKFRIVKLTKKDQFIVAYGGLRGAIAFSLGYLLSNSHQMRNLFLTAIITVIFFTVFVQGMTIRPLVELLAVKKKKESKPSINEEIHTEFLDHLLTGVEGVCGHYGHYHWKEKLNRFNKTYVKRWLIAGENFKEPELIAFYRKMELKQAIMMVESGQLPSVLPSTISMQNIQPRAIPRVSKKREEEIRRILRANLQNNKQKMRSRSYSRHTLFDADEEDNVSEVRLRKTKMEMERRVSVMERRMSHYLTVPANRESPRPGVRRVRFESDNQVFSADSFPTVHFEQPSPPSTPDAVSLEEEEEEVPKRPSLKADIEGPRGNASDNHQGELDYQRLARCLSDPGPNKDKEDDDPFMSC

SEQ ID NO: 24342 - protein, 301 aa, Homo sapiens [sequence omitted]

SEQ ID NO: 24343 - protein, 298 aa, Mus musculus
MTDAAVSFAKDFLAGGVAAAISKTAVAPIERVKLLWQVQTNDRTITADKQYKGIIDCVVRIPKEQGVLSFWRGNLANVIRYFPTQALNFAFKDKYKQIFLGGVDKRTQFWRYFAGNLASGGAAGATSLCFVYPLDFARTRLAADVGKAGAEREFKGLGDCLVKIYKSDGIKGLYQGFNVSVQGIIIYRAAYFGIYDTAKGMLPDPKNTHIFISWMIAQSVTLVAGLTSYPFDTVRRRMMMQSGRKGTDIMYTGTLDCWRKIARDEGSKAFFKGAWSNVLRGMGGAFVLVLYDEIKKYT

SEQ ID NO: 24344 - protein, 417 aa, Hevea brasiliensis
MAKKAVLIGINYPGTKAELKGCINDVKRMYRCLVDRYGFSEEDITVLIDIDESYIQPTGKNIRRVLTDLVRSAEPGDLLFVHYSGHGTRLPAETGEDDDTGFDECIVPCDMNLITDDDFREFVDQVPHGCRITVVSDSCHSGGLIDEAKEQIGESTKRKEEESESGFGFKSFLKQTIQDAFESRGVHLPSDLHHHHGHRDEEDFDNRVVEEDYGDSGYVKSKSLPLSTLIEILKQKTGKDDIDVGKLRPTLFDMFGDDASPKVKKFMKVILNKLRHGDGESGGGGFLGMVGSLAQEFLKHKLDENDESYVKPALETEVDSKQEVYAGKTKRSLPDGGILISGCQTDQTSADASPSGKSSEAYGALSNAIQTIIAETDGAVTNQELVLKARKMLKKQGFTQKPGLYCSDDHVEASFVC

SEQ ID NO: 24345 - protein, 1217 aa, Rattus norvegicus
VVETLRRGSKFIKWDEEASCRNLVTLRVDPNGFFLYWTGPNMEVDTLDISSIRDTRTGRYARLPKDPKIREVLGFGGPDTRLEEKLMTVVAGPDPVNTTFLNFMAVQDDTVKVWSEELFKLAMNILAQNAPEHVLRKAYTKLKLQVNQDGRIPVKNILKMFSADKKRVETALICGLNFNRSESIRPDEFSLEIFERFLNKLLLRPDIDKILLEIGAKGKPYLTLEQLMDFINQKQRDPRLNEVLYPPLRSSQARLLIEKYEPNKQFLERDQMSMEGFSRYLGGEENGILPLEALDLSMDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGEALLIDPLDKYPLSAGTPLPSPQDLMGRILVKNKKRHRPSTGVPDSSVAKRPLEQSNSALSESSAATEPSSPQLGSPSSDSCPGLSNGEEVGLEKTSLEPQKSLGEEGLNRGPNVLMPDRDREDEEEDEEEEETTDPKKPTTDEGTASSEVNATEEMSTLVNYVEPVKFKSFEASRKRNKCFEMSSFVETKAMEQLTKSPMEFVEYNKQQLSRIYPKGTRVDSSNYMPQLFWNVGCQLVALNFQTLDLPMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGRFVGHRILPVSAIRSGYHYVCLRNEANQPLCLPALLIYTEASDYIPDDHQDYAEALINPIKHVSLMDQRAKQLAALIGESEAQASTEMCQETPSQQQGSQLSSNPVPNPLDDSPRWPPGPTTSPTSTSLSSPGQRDDLIASILSEVTPTPLEELRSHKAMVKLRSRQDRDLRELHKKHQRKAVALTRRLLDGLAQARAEGKCRPSSSALSRATNVEDVKEEEKEAARQYREFQNRQVQSLLELREAQADAETERRLEHLKQAQQRLREVVLDAHTTQFKRLKELNEREKKELQKILDRKRNNSISEAKTREKHKKEVELTEINRRHITESVNSIRRLEEAQKQRHERLLAGQQQVLQQLVEEEPKLVAQLTQECQEQRERLPQEIRRCLLGETSEGLGDGPLVACASNGHAAGSGGHQSGADSESQEENTQL

SEQ ID NO: 24346 - protein, 380 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLERMLVFDPKKRITAADALVHPYLAPYHDPTDEPTAEAQFDWDFNDADLPVDTWRVMMYSEILDFHKIGGGDGQIDTNAAFDDQVAAATAAPMAQHTNQTNQ

SEQ ID NO: 24347 - protein, 624 aa, Ascidia sydneiensis samea
MAEYHAPDNKTVHELNNIANRIRINSILSTSKSNSGHPTSSSSCAEILSVLFFRIMKYKVDVPRDISSDRFVMSKGHACPALYSAWVETGHMTKEQLMTLRENGSVYEGHPTPKIDFIDVATGSLGQGLGMAAGMAYVGKYIDKSNYRVYCLLGDGEVAEGAVWEAMAFASHYKLDNLVAIIDVTRLGQSEETALGHHTEIYKKRAEAFGWNSIEVDGHCVSELSKSFHLAESCKDLPTCLVAKTFKGKNMIGQENLHGFHGKPVSPASKEEILNHLEKLVSENSGVKLTPTLPVDDTKPVDISNIKLSSPPDYELGQKIATRAGYGKALIKIGQRCDRVYSLDGDMKNSTFAQDYKKAFPDHFIECFIAEQNMVGVGIGMATRDRTVVFLSTFAAFMARAYDHIRMGAVCHTNINIFGSHCGISIGADGPSQMALEDLAMFRAVQGSTVFYPSDVVSVERAVELSANTKGICFIRGARAATPVVYDKDTKFEVGRCQILKQKSGDKVTIVAGGITFAEALKAFDKLQTDGIGVTLIDIFSVKPVDKDGIYQAAWQPGKDPHGGDHYEEGGIGSAVAEALSECTGITQKRLAVRGLPYSAAPNELLAAFKIDCDAIVEAVKSML

SEQ ID NO: 24348 - protein, 619 aa, Homo sapiens
EPVVAAEAVMSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 24349 - protein, 416 aa, Anabaena sp.
MPATSFYADAAYNTQKSRQALDPDIAIDDSDLSVDEIQELEIAAADPATFGRSANRRSTDLVRLYLQEIGRVRLLGRDEEVSEAQKVQRYLKLRIVLANAVKQGDEVATPYLHLIEVQERLASELGHRPSLERWAATAGINLCDLKPILSEGKRRWAEIAKMTVEELEKMQSQGLQSKEHMIKANLRLVVSVAKKYQNRGLELLDLVQEGTLGLERAVEKFDPTKGYRFSTYAYWWIRQGITRAIATSSRTIRLPVHITEKLNKIKKAQRKIAQEKGRTPTLEDLAIELDMTPTQVREVLLRVPRSVSLETKVGKDKDTELGELLETDGVTPEEMLMRESLQRDLQHLLADLTSRERDVILMRFGLADGHPYSLAEIGRALDLSRERVRQIESKALQKLRQPKRRNLIRDYLESLS

SEQ ID NO: 24350 - protein, 225 aa, Ilyanassa obsoleta
LYKVMQTFNLMDVVPVAQMVLGVVKFFVVCVGGLVIGIISGAGSSFLTRLTTHVGVAQPLVIYTTAYLSFLLSELFEVSGIISLIACGLVQRHYAFSNISYKSRTTVKYFTKVLASANEIIIFLFLALELVSETHQWHTGFVLWTLLLCTLFRFLLTFGMACLINRFDTMRVRLIGYDEMFMIAFGGLRGTVAFSLAALLDEEDLPMKRMFVTTTLVVVMFTVFV

SEQ ID NO: 24351 - protein, 514 aa, Mus musculus
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDRFLEEIMTKREDLVVAPAGVTLKEANEILQRSKKGKLPIVNENDELVAIIARTDLKKNRDYPLASKDAKKQLLCGAAIGTHEDDKYRLDLLALAGVDVVVLDSSQGNSIFQINMIKYIKEKYPSLQVIGGNVVTAAQAKNLIDAGVDALRVGMGSGSICIIQEVLACGRPQATAVYKVYEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 24352 - protein, 246 aa, Mustela vison
HEDIHTYLREMEVKCKPKVGYMKKEPDITNSMRAILVDWLVEVGEEYKLQNETLHLAVNYIDRFLSSMSVLRGKLQLVGTAAMLLASKFEEIYPPEVAEFVYVTDDTYTKKQVLRMEHLVLKVLAFDLAAPTVNQFLTQYFLHHDSANCKVESLAMFLGELSLIDADPYLKYLPSVIAAAAFHLALYTVTGQSWPESLVQKTGYTLESLKPCLMDLHQTYLRAPQHAQHAIRENIKVQSIMVIAVS

SEQ ID NO: 24353 - protein, 346 aa, Escherichia coli
MRIEEDLKLGFKDVLIRPKRSTLKSRSDVELERQFTFKHSGQSWSGVPIIAANMDTVGTFSMASALASFDILTAVHKHYSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIVSDGGCTTPGDVAKAFARADFVMLGGMLAGHEESGGRIVEENGEKFMLFYGMSSESAMKRHVGGVAEYRAAEGKTVKLPLRGPVENTARDILGGLRSACTYVGASRLKELTKRTTFIRVQEQENRIFNNL

SEQ ID NO: 24354 - protein, 140 aa, Homo sapiens
NRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 24355 - protein, 69 aa, Homo sapiens
ERYDDMAACMKSVTEQGAELSNEERNLLSVAYKNVVGARRSSWRVVSSIEQKTEGAEKKQQMAREYREK

SEQ ID NO: 24356 - protein, 756 aa, Mus musculus
MEGSPTTATAVEGKVPSPERGDGSSTQPEAMDAKPAPAAQAVSTGSDAGAPTDSAMLTDSQSDAGEDGTAPGTPSDLQSDPEELEEAPAVRADPDGGAAPVAPATPAESESEGSRDPAAEPASEAVPATTAESASGAAPVTQVEPAAAAVSATLAEPAARAAPITPKEPTTRAVPSARAHPAAGAVPGAPAMSASARAAAARAAYAGPLVWGARSLSATPAARASLPARAAAAARAASAARAVAAGRSASAAPSRAHLRPPSPEIQVADPPTPRPPPRPTAWPDKYERGRSCCRYEASSGICEIESSSDESEEGATGCFQWLLRRNRRPGLPRSHTVGSNPVRNFFTRAFGSCFGLSECTRSRSLSPGKAKDPMEERRKQMRKEAIEMREQKRADKKRSKLIDKQLEEEKMDYMCTHRLLLLGAGESGKSTIVKQMRILHVNGFNGDSEKATKVQDIKNNLKEAIETIVAAMSNLVPPVELANPENQFRVDYILSVMNVPNFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 24357 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 24358 - protein, 240 aa, Helianthus annuus
MAFGGTIDKCNACDKTVHFVDLMTVDNVIYHKKCFKCTHCKGTLVMSNYSSMDGVLYCMPHFEQLFKETGNYSKNFRTSKLNRDNSTAQLPNKFSYFFSGTLDKCRICEKTVYFIDKMTMEGESYHKQCFRCVHGGCPLTHSSYAALNGNLYCRHHFAQLFLEKGTLSHVLKAAADRKKNTIPDHQAEAEKVPLPEQESEVEKALEPQQENQVEKVAETEVESKLDTTEEVDDEQESETV

SEQ ID NO: 24359 - protein, 372 aa, Lycopersicon esculentum
MAIDCMVMPMIQDEKKSLIFDSSVLKNESNIPRQFIWPDHEKPSGFVGELDVPLIDLGAFLSGDPIAAKRESSLVDEACKKHGFFLVANHGVDTNLISLAHRYMDMFFELPLSDKQKIQRKRGDHCGYASSFTERFSSKLPWKETLSFPYSTLQGSSHMLDQYFLKTMGEDFSHIGKFYQEYCNAMSTLSSGIMELLGESLGVSKNHFKQFFEENESIMRLNYYPTCLKPDLALGTGPHCDPTSLTILHQDNVSGLQVFMDNQWRSISPNNSAFVVNIGDTFMALSNGRYKSCLHRAVVNNKTPRKSLAFFLCPKKDKVVRPPAELVDSNNPRIYPDFTWPTLFEFTQKHYRADTNTLRFFSTWLQQKTTEI

SEQ ID NO: 24360 - protein, 378 aa, Lycopersicon esculentum
MAIDCMITNGKSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLHDQHNTTTQA

SEQ ID NO: 24361 - protein, 379 aa, Lycopersicon esculentum
MAIDYMITRNNNMISKEDQVSNKSLSFNASLMKNESNIPSQFIWPDHEKPNYASVTRELQVPLIDLSGVLSNDPIEIKKATRLVNEACTKHGFFLVVNHGVDTNLIKNAHVYIDKFFQLPLCEKQKAQRKVGEHCGYASSFVGRFSSKLPWKETLSFQYSDQKGSSHIVEDYFQRTLGEKFSYIGKVYQEYCNAVSTLSLGIMELLGLSLGVSKNHFKEFFQGNESIMRLNYYPTCQKPELTLGTGPHCDPTSLTILHQDSVGGLQVFVDNEWHTITPNFNAFVVNIGDTFMALSNGRYKSCLHRAVVNNKIPRKSLAFFLCPKKDKVITPPNELVDSNNPRIYPDFTWPTLLEFTQKQYRADMNTLQTFSNWLKKTQS

SEQ ID NO: 24362 - protein, 371 aa, Amblyomma americanum
MGNAATTKKGDPAENGGATPTQSKPPPFKSSGIVSVERFLEEARKSFEQKWTSPSSNTASLDDFDRIKTLGTGSFGRVMLVQHKQHKDYFAMKILDKQKVVKLKQVEHTLNEKRILQAVEFPFLVKLAYHFKDNSNLYMVLEYVLGGEMFSHLRKSGRFSEPHARFYGAQIVLAFQYLHSLDLIYRDLKPENLLIDHTGYIKVTDFGFAKRVRGRTWTLCGTPEYLAPEIILSKGYNKAVDWWALGVLVYEMAAGYPPFFADQPIQIYEKIVSGKVRFPSHFTSDLKDLLRNLLQVDLTKRFGNLKNGVNDIKNHRWFATTDWIAIYKKEVEAPFVPKCKGPGDTSNFDEYEEEALRISSTEKCAREFAEF

SEQ ID NO: 24363 - protein, 421 aa, Amblyomma americanum
MRKWFSGKQKQTELSAGPAKVEQPATTPASVVQKSAAGAPLTKAAPPGQKKTSQQQVVSPSGGSIANVSQSSPEISEEETQSSVRFERFLEEARKSFEQKWTSPSSNTASLDDFDRIKTLGTGSFGRVMLVQHKQHKDYFAMKILDKQKVVKLKQVEHTLNEKRILQAVEFPFLVKLAYHFKDNSNLYMVLEYVLGGEMFSHLRKSGRFSEPHARFYGAQIVLAFQYLHSLDLIYRDLKPENLLIDHTGYIKVTDFGFAKRVRGRTWTLCGTPEYLAPEIILSKGYNKAVDWWALGVLVYEMAAGYPPFFADQPIQIYEKIVSGKVRFPSHFTSDLKDLLRNLLQVDLTKRFGNLKNGVNDIKNHRWFATTDWIAIYKKEVEAPFVPKCKGPGDTSNFDEYEEEALRISSTEKCAREFAEF

SEQ ID NO: 24364 - protein, 462 aa, Amblyomma americanum
MNIFKNRGRKKEKGPVEVVAVTLYDAFDGQQQQQAPGGPKSASAPATPQGGGAGGHAASQSSQQQPQQKDKDKQSPAAGAPVRGNGLSPPCPQSAPCTPPATSNNTTASNQATTSADMPPFKEPKDFERFLEEARKSFEQKWTSPSSNTASLDDFDRIKTLGTGSFGRVMLVQHKQHKDYFAMKILDKQKVVKLKQVEHTLNEKRILQAVEFPFLVKLAYHFKDNSNLYMVLEYVLGGEMFSHLRKSGRFSEPHARFYGAQIVLAFQYLHSLDLIYRDLKPENLLIDHTGYIKVTDFGFAKRVRGRTWTLCGTPEYLAPEIILSKGYNKAVDWWALGVLVYEMAAGYPPFFADQPIQIYEKIVSGKVRFPSHFTSDLKDLLRNLLQVDLTKRFGNLKNGVNDIKNHRWFATTDWIAIYKKEVEAPFVPKCKGPGDTSNFDEYEEEALRISSTEKCAREFAEF

SEQ ID NO: 24365 - protein, 297 aa, Nepenthes alata
DQFDDTDPREKIKKGSFFNWFYFSVNIGALISSSLIVWVQENLGWALGFGIPAISMGIAIASFFSGTALYRLQKPGGSPLTRMCQVLVASFRKSKLALPEDSNLLYETSDENSVIEGGRKLEHTNDLKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKSTGKQRGFSELQRMGIGLFISILSMAAAALVEMKRLQLAKELGLVDEDVAVPLSIFWQIPPYF

SEQ ID NO: 24366 - protein, 205 aa, Eucalyptus globulus subsp. globulus
MVRGKTQMKRIENDTSRQVTFSKRRNGLLKKAFELSVLCDAEVALIIFSPRGKLYEFSSSSLCKTIEKYQTRAKDMEAKTAEISMQPSKGNTLDMEKKIEHFEISRRRLLGEGLDSCSVEELQQTENQLERSLTKIRARKNHLIREHIERLKAEERKLLEEKRKLLQEIECGKGLTPVSSERPREEIRAESMDVETELFIGPPKR

SEQ ID NO: 24367 - protein, 2360 aa, Cryptococcus neoformans var. grubii
MSSQSDVLDNIFQRLSARSEDVRAQAGQDLAEHVVAYTQEYPGHDASKGVWAQVFHKTFEFTRSNNQLERLGAIIAISQLLQLTKDDTPDRAQQKVLRLYEYLRPLTTCGDSTVMLPASLVVEDMVRNSPTLHTDTFLGKEVGQALVMIDDSRQEVGRFSGALLLYAFARAAPGVFHQYISKVLEKIWIPLRDSRSVVRERASMLLSTCLDTLKTRGDRPSTDTYRKIFEEARLGLLKASSTESILGSLLAFNSMLQNQQLSMAEYYRSICELTFKYRDSKEVSIRKAVIALIPSMATYDSDDFEAHYLHRGMAYLLQALNRPADRDISYVALGHMAVHLGSKMKPFIDDIMRIIRDHLRMRGKKNAPYEAPIFQCLAMLATSVGPMLTRQMHEILDLMFPWGLSEPLCTALQATASHIPPLLRTIQDRLLEMLSQTLTGQSYRPLGAPAPRGGAQMDLNLLQSTTNAQSTDTLKLALRLLARFDFVGHTLSEFVRDAALPYLEHDSVEVRREAVLATTTLFMTDPICQQTSSNSVEIVNDVLSKLLTVAITDPNAGIRRTVLDHLEDKFDRHLAQAADIRCLFIALNDEVFGNRERTISIIGRLAHHNPAYVMPHLRKSLINIVTELEYSTNARQKEESAKLLCLMIGAAAGLVKSYAPTILSVLLRTASSPESSIGVQAECLKCIGELARVAGEELVPSVRAILDLVIEMLNDQSSPAKRDTALKTLGQIASNTGEVIKPYTDYPQLMGVLFKFLRMEANSSVRQETIKTIGMLGALDPFKHKTLLGDVDDPIDEGTTSRVNDIVLLNQHNSSVNDEFFQTVVIHSLVNVLHDSTYKDHYQAVEAIMMIFRTQRLRCVNFLPQIVPAFLNVIRIAHSSRTELYLKQLAQFITIVKLHIRNYLNDVFDLIHEFWNPNSTLQITIISLVEAIAKAVEGEFKAYLPKLLQQILRSFDGDLSAKHLPELKLNTLLQILKAFYVFGESIEDYLHLVLPVIVRSFENPAAPDSLRIAALRTTGQLCRKVNFSDHASQIIHPLVRTLGNSSEELRQTAMETLCVLVLQFGPDYAIFIPMVNKALVENKISHPGYEALITKLLNRERLPPDLGPVERYASDSAAEASAPEPVALKVNQQALKLAWDCSHLLNTSSRTEWISWIIGLGHEMMRESPSQAIRAARSLALSSVAFTKELFNVAFYSCWQELFESYQEDLWHNLDRAIKKDDVPGDVVNMILGATQFLEHDEKEVAIESRVLGSVAANYQALAVALHYKEQEFFLDPSKEVIEDLIDVNQKLQQSDAAWGTLEWAQTEMGMTTEVEWYEKLGRWEEALQVWNERDADASTTFSEWEITEGKVTCLHAMGEWEQLSDFVQARWANRTAEEKKLLSPLAAAASWSLKQWDLMDDYISAMKGDGADRAFFKAILAVHRNQIPAALKQISKARERLDPELTTLTGDSYGRAYDTVVRIQMLAELEEIIAYKDHADEPARQEMQRQTWKKRLAGCQRDVEVWQRILQVRSLVLKPNEDMDTWIEFADLCRTSDRLNLAEKTLTSLVGFQYPSMEDTRGRAPPPIIFAYLRMAWAKNLQIDSREERYETLQHLRDFTDQLTDDVGIGARGPNGRLMLPDQKLYGSYTKLLAQCHVELGQWQATLRESQGSADPSGILHDYCLATELDPEWYQAWHTWALANFEVITQLEVSQQGLSPVHFTTYIIPAVEGFLKSISLSPGNSLQDTLRLLTLWFTYGYSSGVTAAVSQGLPTVNIDVWLEVIPQIIARIQTPRQSIQQLIVQLLHDIGKAHPQALIYPLTVASKSTVAARRTVAQNITHKMREHSPKIVDQAELVSTELIRAAILWHEMWYDGLEEASKHYFGDHDIPGMLGVLEPLHEIVENGPQTLRETSFIQSFGHDLRIAREHLKRYRITQDGTEIQQAWDVYYSVFQRLGKQLKLLNVIELQYVSPKLMAVRDLDIAVPGTYQSGKPIIGIKNVIPTFKVIASKQKPRQCSMRGMDGKEYAYCLKGHEDLRQDERVMQLFGLVNTLLNNDHESAKRHLSIQRFSVTPLSPSAGLLGWVTHSDTIHVLIKQYRDQRKILVDIEHKLMQQMSDESYDSLPLLHKVEIFQYALDNTTGQDLYRILWLKSRNSDIWLERRTTYTRSLGLNSMVGYILGLGDRHPSNLLLDQITGKMVHIDFGDCFEVAQQRDKYPEKVPFRLTRMLIHAMEVCGITGNFSRSCEVSMEVLRDNRESLMAVLEAFVYDPLIAWRLTATDKRPGGVGEVKDLDDPAVYGKQRKNKANETEILNDVENTEVKNDKGLQVIERVRRKLTGRDFKPDVVLDVKSQVEKLVVEATKTENLCVAFLGWCSFW

SEQ ID NO: 24368 - protein, 1083 aa, Cryptococcus neoformans var. neoformans
EFGTSEDLIDVNQKLQQSDAAWGTLEWAQTEMGMTTEVEWYEKLGRWEEALQVWNERDADASTTFSEWEITEGKVTCLHAMGEWEQLSDFVQARWANRTAEEKKLLSPLAAAASWSLKQWDLMDDYISAMKGDGADRAFFKAILAVHRNQIPAALKQISKARERLDPELTTLTGDSYGRAYDTVVRIQMLAELEEIIAYKDHADEPARQEMQRQTWKKRLAGCQRDVEVWQRILQVRSLVLKPNEDMDTWIEFADLCRTSDRLNLAEKTLTSLVGFQYPSMEDTRGRAPPPIIFAYLRMAWAKNLQIDSREERYETLQHLRDFTDQLTDDVGIGARGPNGRLMLPDQKLYGSYTKLLAQCHVELGQWQATLRESQGSADPSGILHDYSLATELDPEWYQAWHTWALANFEVITQLEVSQQGLSPIHFTTYIIPAVEGFLKSISLSPGNSLQDTLRLLTLWFTYGYSSGVTAAVSQGLPTVNIDVWLEVIPQIIARIQTPRQSIQQLIVQILHDIVKAHPQALIYPLTVASKSTVAARSTVAQNITHKMREHSPKIVDQAELVSTELIRAAILWHEMWYDGLEEASKHYFGDHDIPGMLGVLEPLHEIVENGPQTLRETSFIQSFGHDLRIAREHLKRYRITQDGTEIQQAWDVYYSVFQRLGKQLKLLNVIELQYVSPKLMAVRDLDIAVPGTYQSGKPIIGIKNVIPTFKVIASKQKPRQCSMRGMDGKEYAYCLKGHEDLRQDERVMQLFGLVNTLLNNDHESAKRHLSIQRFSVTPLSPIAGLLGWVTHSDTIHVLIKQYRDQRKILVDIEHKLMQQMSDESYDSLPLLQKVEIFQYALDNTTGQDLYRILWLKSRNSDIWLERRTTYTRSLGLNSMVGYILGLGDRHPSNLLLDQITGKMVHIDFGDCFEVAQQRDKYPEKVPFRLTRMLIHAMEVCGITGNFSRQCEVSMEVLRDNRESLMAVLEAFVYDPLIAWRLTATDKRPGGVGEVKDLDDPAVYGKQRKNKANETEILNDVENTEVKNDKGLQVIERVRRKLTGRDFKPDVVLDVKSQVEKLVVEATKTENLCVAFLGWCSFW

SEQ ID NO: 24369 - protein, 962 aa, Mus musculus
VQHSINRKQSWKGSKESLVPQRHGPSLGENVVYRSESPNSQADVGRPLSGSGIAAFAQAHPSNGQRVNPPPPPQVRSVTPPPPPRGQTPPPRGTTPPPPSWEPSSQTKRYSGNMEYVISRISPVPPGAWQEGYPPPPLTTSPMNPPSQAQRAISSVPVGRQPIIMQSTSKFNFTPGRPGVQNGGGQSDFIVHQNVPTGSVTRQPPPPYPLTPANGQSPSALQTGASAAPPSFANGNVPQSMMVPNRNSHNMELYNINVPGLQTAWPQSSSAPAQSSPSGGHEIPTWQPNIPVRSNSFNNPLGSRASHSANSQPSATTVTAITPAPIQQPVKSMRVLKPELQTALAPTHPSWMPQPVQTVQPTPFSEGTASSVPVIPPVAEAPSYQGPPPPYPKHLLHQNPSVPPYESVSKPCKDEQPSLPKEDDSEKSADSGDSGDKEKKQITTSPITVRKNKKDEERRESRIQSYSPQAFKFFMEQHVENVLKSHQQRLHRKKQLENEMMRVGLSQDAQDQMRKMLCQKESNYIRLKRAKMDKSMFVKIKTLGIGAFGEVCLARKVDTKALYATKTLRKKDVLLRNQVAHVKAERDILAEADNEWVVRLYYSFQDKDNLYFVMDYIPGGDMMSLLIRMGIFPENLARFYIAELTCAVESVHKMGFIHRDIKPDNILIDRDGHIKLTDFGLCTGFRWTHDSKYYQSGDHPRQDSMDFSNEWGDPSNCRCGDRLKPLERRAARQHQRCLAHSLVGTPNYIAPEVLLRTGYTQLCDWWSVGVILCEMLVGQPPFLAQTPLETQMKVIIWQTSLHIPPQAKLSPEASDLIIKLCRGPEDRLGKNGADEIKAHPFFKTIDFSSDLRQQSASYIPKITHPTDTSNFDPVDPDKLWSDGSEEENISDTLSGWYKNGKHPEHAFYEFTFRRFFDDNGYPYNYPKPIEYEYIHSQGSEQQSDEDDQHTSSDGNNRDLVYV

SEQ ID NO: 24370 - protein, 717 aa, Plasmodium falciparum
MDLFYVFLLLPPTIGLIFSIIECIWVSNINIKGPEDKVEKLEDGDNPVEKMKEIASYIAVGANAFLKKEFQYLAVFIIVFSILLGFFVNSFTAVSFVLGCLTSILCGYIGMKIAVYANVRTTNETWKSLDKGFQVTLNAGTVMGFSLVSFGIIALGLLIFVYKTYVFKNTIPDNQIYKIIAGFGLGGSSIALFSRVGGGIYTKAADVGADLSGKNEYGIPEDDIRNPACIADNVGDNVGDMAGMGADLFGSLAESLCAALVIGSSVISIGEGSPGNAFHCILFPLLFVSFSVICSMITFYIITYSVKINDKKDVEKSLKYLLLLSTVLQSLAILAIGYVCFPSLVKYNYLKDIHRWKIIVPALVGLWSGLIIGFTTEFYTSYSFSPVQEIAHTQKVSAATGIIYGLSLGYKSTFIPIICLSATLGISYGLCDIYGIALAAVGMLSTLCICLTIDAYGPISDNAGGIAEMAGLPSEVRERTDILDAAGNTTAAIGKGFAIGSAALVAFALFGAYASSANLRHVNILNSWVIIGLLIGAMLPYLFSALTMKSVAIAANSVLNECLEQFPLILEGKQKPDYEKCIKISTDASLRQMIVPGLISVFSPLIIGMLMGKYATAGLLIGIILSGIQLAFSSTNSGGAWDNAKKYIESGALGKEHCKGSNAHKNSVIGDTVGDPLKDTSGPSLNILIKLSAITSLVFANVIATKFTSTRGGPIWL

SEQ ID NO: 24371 - protein, 128 aa, Plasmodium falciparum
MDLFYVFLLLPPTIGLIFSIIECIWVSNINIKGPEDKVEKLEDGDNPVEKMKEIASYIAVGANAFLKKEFQYLAVFIIVFSILLGFFVNSFTAVSFVLGCLTSILCGYIGMKIAVYANVRTTNETWKS

SEQ ID NO: 24372 - protein, 482 aa, Toxoplasma gondii
MANTGPITNYYTVSKTIGRGTWGEVKLVIDNGTGARRAAKKIPKCYVEDADRFRQEIEIMKSLDHPNIVRLYETFEDMTDFYLVMEYCTGGELFDRLVHQGVFTEALACRIMRQILAAVAYCHAHRVAHRDLKPENFLFLHDNPESPIKLIDFGLAARFKPGQPMRTRAGTPYYVSPQVLEGRYGPECDVWSAGVMMYILLCGYPPFNAPSDRAIMNKVRAGHYTFPDSEWSRVSLQAKDLISRLLDRHPRTRISAEQALRHAWFAMHAPGDHFEPLGLDILSKFRRFQGLSRLKKLALTVIAQHLEDSEIEGLKNLFTQLDTEGDGVLTVEEIRKGIERSGVHLPPDMVLEDVLREVDTAGTGSIDYTEFIAACLHQSHYIREEACRAAFRVLDINGDGLVSAQELRQVFHMAGDLETDAAAELLEADADGDGHITFDEFCGLMRKVPSLALVTEHTVSMMRRTCSRTNISEASLTPRATG

SEQ ID NO: 24373 - protein, 297 aa, Drosophila melanogaster
MEDFEKIEKIGEGTYGVVYKGRNRLTGQIVAMKKIRLESDDEDVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVADFGLGRSFGIPVRIYTHEIVTLWYRAPEVLLGSPRYSCPVDIWSIGCIFAEMATRKPLFQGDSEIDQLFRMFRILKTPTEDIWPGVTSLPDYKNTFPCWSTNQLTNQLKNLDANGIDLIQKMLIYDPVHRISAKDILEHPYFNGFQSGLVRN

SEQ ID NO: 24374 - protein, 297 aa, Drosophila melanogaster
MEDFEKIEKIGEGTYGVVYKGRNRLTGQIVAMKKIRLESDDEGVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVVDFGLGRSFGIPVRIYTHEIVTLWYRAPEVLLGSPRYSCPVDIWSIGCIFAEMATRKPLFQGDSEIDQLFRMFRILKTPTEDIWPGVTSLPDYKNTFPCWSTNQLTNQLKNLDANGIDLIQKMLIYDPVHRISAKDILEHPYFNGFQSGLVRN

SEQ ID NO: 24375 - protein, 297 aa, Drosophila melanogaster
MEDFEKIEKIGEGTYGVVYKGRNRLTGQIVAMKKIRLESDDEGVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVADFRLGRSFGIPVRIYTHEIVTLWYRAPEVLLGSPRYSCPVDIWSIGCIFAEMATRKPLFQGDSEIDQLFRMFRILKTPTEDIWPGVTSLPDYKNTFPCWSTNQLTNQLKNLDANGIDLIQKMLIYDPVHRISAKDILEHPYFNGFQSGLVRN

SEQ ID NO: 24376 - protein, 297 aa, Drosophila melanogaster
MEDFEKIEKIGEGTYGVVYKGRNRLTGQIVAMKKIRLESDDEGVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVADFGLGRSFGIPVRIYTHEIVTLWYRAPEVLQGSPRYSCPVDIWSIGCIFAEMATRKPLFQGDSEIDQLFRMFRILKTPTEDIWPGVTSLPDYKNTFPCWSTNQLTNQLKNLDANGIDLIQKMLIYDPVHRISAKDILEHPYFNGFQSGLVRN

SEQ ID NO: 24377 - protein, 297 aa, Drosophila melanogaster
MEDFEKIEKIGEGTYGVVYKGRNRLTGQIVAMKKIRLESDDEGVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVADFGLGRSFGIPVRIYTHEIVTLWYRAPEVLLGSPRYSCPVDIWSIGCIFAEMATRKPLFQDDSEIDQLFRMFRILKTPTEDIWPGVTSLPDYKNTFPCWSTNQLTNQLKNLDANGIDLIQKMLIYDPVHRISAKDILEHPYFNGFQSGLVRN

SEQ ID NO: 24378 - protein, 297 aa, Drosophila melanogaster
MEDFEKIEKIGEGTYGVVYKGRNRLTGQIVAMKKIRLESDDEGVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVADFGLGRSFGIPVRIYTHEIVTLWYRAPEVLLGSPRYSCPVDIWSIGCIFAEMATRKPLFQGDSEIDQLFRMFRILKTPTEDIWPGVTSLPDYKNTFSCWSTNQLTNQLKNLDANGIDLIQKMLIYDPVHRISAKDILEHPYFNGFQSGLVRN

SEQ ID NO: 24379 - protein, 297 aa, Drosophila melanogaster
MEDFEKIEKIGEGTYGVVYKGRNRLTGQIVAMKKIRLESDDEGVPSTAIREISLLKELKHENIVCLEDVLMEENRIYLIFEFLSMDLKKYMDSLPVDKHMESELVRSYLYQITSAILFCHRRRVLHRDLKPQNLLIDKSGLIKVADFGLGRSFGIPVRIYTHEIVTLWYRAPEVLLGSPRYSCPVDIWSIGCIFAKMATRKPLFQGDSEIDQLFRMFRILKTPTEDIWPGVTSLPDYKNTFPCWSTNQLTNQLKNLDANGIDLIQKMLIYDPVHRISAKDILEHPYFNGFQSGLVRN

SEQ ID NO: 24380 - protein, 534 aa, Mesembryanthemum crystallinum
MGICASKNKATQPEDNGYTPANGVGSNNQSKPPAQQNYHQQPPQQPVAPPQPASHPPVRMPSPKPAPKVEPNTILGKPFEDVKVYYTLGRELGRGQFGVTYLCTDKKTGQQYACKSISKKKLVTKADKDDMRREIQIMQHMSGQPNIVEFKGAYEDKTSVNLVMELCAGGELFDRIIAKGHYSEKAAATMLRQIVNVVHVCHFMGVMHRDLKPENFLLSSKDENSLLKATDFGLSVFIEEGKVYRDIVGSAYYVAPEVLRRRYGKEIDVWSAGVMLYILLSGVPPFWAETEKGIFDAILQGHIDFESKPWPSISNGAKDLVRKMLTQDPKKRITAAQVLEHPWLRDGEASDKPIDSAVLLRMKQFRVMNKLKKLALKVIAENLPDEEIQGLKQMFANMDTDGSGSITYEELREGLARLGSKLTETEVKALMEAADQDGSGSIDYYEFITATMHRYRLERDEHLYKAFQYFDKDNSGFITTDELETAMKEYGIADENCIAEILLEVDTDNDGRINYDEFSAMMRSGTQNPVTKLI

SEQ ID NO: 24381 - protein, 378 aa, Raoultella planticola
MTLSISDQNKLDSFWSYCVKNQYFNIGYPESADFDYTILERFMRFSINNCGDWGEYCNYLLNSFDFEKEVMEYFAQLFKIPFEESWGYVTNGGTEGNMFGCYLGREIFPNGTLYYSKDTHYSVAKIVKLLRIKSTLVESQPNGEMDYADLIKKIKADNEKHPIIFANIGTTVRGAIDNIAIIQQSISELGIERKDYYLHADAALSGMILPFVDNPQPFNFADGIDSIGVSGHKMIGSPIPCGIVVAKKKNVDRISVEIDYISAHDKTISGSRNGHTPLMMWEAIRSHSWEEWRRRIERSLNMAQYAVDRFQSAGIDAWRNKNSITVVFPCPSEAVWKKHCLATSGDIAHLIATAHHLDSSKIDALIDDVIADLKKQAA

SEQ ID NO: 24382 - protein, 807 aa, Arabidopsis thaliana
MANAERMITRVHSQRERLNETLVSERNEVLALLSRVEAKGKGILQQNQIIAEFEALPEQTQKKLEGGPFFDLLKSTQEAIVLPPWVALAVRPRPGVWEYLRVNLHALLVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKPETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELDGKPDLIIGNYSDGNLVASLLAHKLGVTQQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVIVGGDRRKESKDNEEKAEMKKMYDLIEEYKLNGQFRWISSQMDRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEDEYTWQIYSQRLLTLTGVYGFWKHVSNLDRLEARRYLEMFYALKYRPLAVPLAQDD

SEQ ID NO: 24383 - protein, 246 aa, Homo sapiens [sequence omitted]

SEQ ID NO: 24384 - protein, 71 aa, Blepharisma sp.
KRHRRVIRENIQGITKPAIRRLARRGGVKRLSGLVYDETRNVLKVFLEGVVRDAVTYTEHARRKTVTALDV

SEQ ID NO: 24385 - protein, 71 aa, Blepharisma undulans
KRHRRVIRENIQGITKPAIRRLARRGGVKRLSGLVYDETRNVLKVFLEGVVGDAVTYTEHARRKTVTALDV

SEQ ID NO: 24386 - protein, 71 aa, Blepharisma undulans
KRHRRVIRENIQGITKPAIRRLARRGGVKRLSGLVYDDTRNVLKVFLEGVVRDAVTYTEHARRKTVTALDV

SEQ ID NO: 24387 - protein, 71 aa, Euplotes eurystomus
RHTKKALRETILGVTKPAIRRLARRGGVKRISSLVYEETRAVLKGFLENVIRDSVTYTEHAKRKTVTALDV

SEQ ID NO: 24388 - protein, 71 aa, Euplotes eurystomus
RHTKKAFRETILGVTKPAIRRLARRGGVKRISSLVYEETRAVLKGFLENVIRDSVTYTEHAKRKTVTALDV

SEQ ID NO: 24389 - protein, 71 aa, Euplotes minuta
RHAKKTLRETILGVTKPAIRRLARRGGVKRISSLVYEETRAVLKGFLESVIRDSVTYTEHAKRKTVTALDV

SEQ ID NO: 24390 - protein, 71 aa, Euplotes vannus
RHAKKALRETILGVTKPAIRRLARRGGVKRISSLVYEETRAVLKGFLESVIRDSVTYTEHAKRKTVTALDV

SEQ ID NO: 24391 - protein, 458 aa, Zymomonas mobilis
MAYESVNPATGETVKKYPDFSDKQVKDSVDRAATVFKNDWSQRTIAERSKVLHKAAEIFRSDVDKYAKLLTIDMGKKIAEARGEVNLSADILDYYAKNGEKFLAPQKVEEKPGAVVKAFPLGLLLAIEPWNFPYYQLARIAGPYLIAGNALLVKHSSSVPQSAHAFEAVLEEAGAPKGIYTNLDASPDQVSQIIEDPRVRGVTVTGSASVGAELAAKAGKMWKKSVMELGGSDAFIVLDGVDIDDKLIDKAAYGRLFNAGQVFCAAKRFIIVGQKRAELFTEKLKQRFEALKIGDPMDESTDLGPLSSVGARDQVVKQVEKAVQNGAKLVCGGKAIEGKGAFMKAGILTDIKRENPAYFEEFFGPIAQIYAVKDEAEAIELANDSPYGLGGAVFAPDVEQGRKVAEQIETGMVAINKPLWTAPELPFGGVKHSGYGRELSHFGIQEFINWKLIDASAA

SEQ ID NO: 24392 - protein, 53 aa, Protocruzia sp.
RHLHKRVLRESIQGITKPAIRRLARRGGVKRISQLIYDETRNVLRSFLENVVR

SEQ ID NO: 24393 - protein, 72 aa, Protocruzia sp.
RHLHKRVLRESIQGITKPAIRRLARRGGVKRISQLIYDETRNVLRSFLENVVRDAITYTEHARRKTVTAMDV

SEQ ID NO: 24394 - protein, 225 aa, Rana temporaria
MERSLRDVGMDYLDLFLMHWPVSLKPSGASDPSDKDKPFIYDNVDLCATWEALEARKDAGLVRSLGVSNFNRRQLERILNKPGLKYKPVCNQVECHVYLNQNKLHSYCKSKDIVLVTYSVLGSHRDRNWVDLSLPVLLDDPILNKVAAKYNRTSAEIAMRFILQKGIVVLAKSFTPARIKQNLGVFEFELKPEDMKSLESLDRNLHYGPFREVKQHPEYPFHDEY

SEQ ID NO: 24395 - protein, 277 aa, Oryctolagus cuniculus
GFYENYEPKEILGRGVSSVVRRCIHKPTCKEYAVKIIDVTGGGSFSAEEVQELREATLKEVDILRKVSGHPNIIQLKDTYETNTFFFLVFDLMKKGELFDYLTEKVTLSEKETRKIMRALLEVICALHKLNIVHRDLKPENILLDDDMNIKLTDFGFSCQLDPGEKLREVCGTPSYLAPEIIECSMNDNHPGYGKEVDMWSTGVIMYTLLAGSPPFWHRKQMLMLRMIMSGNYQFGSPEWDDYSDTVKDLVSRFLVVQPQKRYTAEEALAHPFFQQY

SEQ ID NO: 24396 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKSRKRQLSNDSTDPIESKTVKKIKCHQWKNLDSMEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 24397 - protein, 223 aa, Oryza sativa
MGRGKIEIKRIKNATNRQVTYSKRRTGIMKKARELTVLCDAQVAIIMFSSTGKYHEFCSPSTDIKGIFDRYQQAIGTSLWIEQYENMQRTLSHLKDINRNLRTEIRQRMGEDLDGLEFDELRGLEQNVDAALKEVRHRKYHVISTQTETYKKKVKHSYEAYKTLQQELGLCEEPAWFVDNTGGGWDGGAGAGAAADMFAFRVVPSQPNLHGMAYGGNHDLRLG

SEQ ID NO: 24398 - protein, 151 aa, Lupinus luteus
LTESQAALVKSSWEEFNANIPKHTHRFFILVLEIAPAAKDLFSFLKGTSEVPQNNPELQAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 24399 - protein, 195 aa, Alexandrium fundyense
VNDCVTKSKFDNVYGCRHSLPDIMRATDVMIGGKRALICGYGDVGKGCALAMRGAGARVLITEIDPICALQACMEGFQVVTLESVVGEVDIFTTTTGNFKIITLEHMKKMKNNAIVGNIGHFDNEIEMAELEGMPGIKVENIKAQVDRFIFPDGHGIIVLASGRLLNLGCATGHPSFVMSCSFTNQVLDNLTLLQ

SEQ ID NO: 24400 - protein, 254 aa, Sinapis alba
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKEREKVLRAQQEQWDEQNHGHNMPPPPPLQQQIQHPYMLSHQPSPFLNMGGLYQEDQIAMRRNDLDLSLEPVYNCNLGCFAA

SEQ ID NO: 24401 - protein, 373 aa, Caiman crocodilus
  unsure (1)..(373): unsure at all Xaa locations
VXVDLYTNKGLFRAAVPSGASTGIYEALELRDNDKSRFMGKGVSKAVAHVNKTIAPALISKNINVVEQEKIDRLMLEMDGSENKSKFGANAILGVSLAVCKAGAAEKGVPLYRHIADLAGNPEVILPVPAFNVINGGSHAGNKLAMQEFMILPVGAETFKEAMRIGAEVYHYLKNVIKEKYGKDATNVGDEGGFAPNILENKEALELLKNAINKAGYSDKIVIGMDVAASEFYRDGKYDLDFKSPDDPSRYITPDQLADLYKSFVKNYPVVSIEDPFDQDDWAAWKKFTASVGIQVVGDDLTVTNPKRIAKAVEDKACNCLLLKVNQIGSVTESLQACKLAQSNGWGVMVSHRSGETEDTFIADLVVGLCTGQ

SEQ ID NO: 24402 - protein, 373 aa, Sphenodon punctatus
VEVDLYTAKGLFRAAVPSGASTGIYEALELRDNDKTRFLGKGVSKAVEHINKTIAPALVNKNISVVEQEKIDKLMVEMDGTENKSKFGANAILGVSLAVCKAGAAEKGVPLYRHIADLAGNAEVILPVPAFNVINGGSHAGNKLAMQDLMILPVGAESFKEAMRIGAEVYHNLKNVIKEKYGKDATNVGDEGGFAPNILENKEALELLKHAINKAGYSDKIVIGMDVAASEFYRDGKYDLDFKSPDDPSRYISPDQLADLYKSFVKNYPVVSIEDPFDQDDWAAWKKFTGSVGIQVVGDDLTVTNPKRITKAVEEKSCNCLLLKVNQIGSMTEYLQACKLAQCNGWGVMVSHRSGETEDTFIADLVVGLCTGQ

SEQ ID NO: 24403 - protein, 373 aa, Eumeces inexpectatus
VEVDLYTDKGLFRAAVPSGASTGIYEALELRDNDKTRFLGKGVSKAVEHVNKTIAPALVNKKVSVVEQEKIDKLMLEMDGSENKSKFGANAILGVSLAVCKAGAAEKGVPLYRHIADLAGNQDVILPVPAFNVINGGSHAGNKLAMQEFMILPVGAENFKEAMRIGAEVYHNLKNVIKEKYGKDATNVGDEGGFAPNILENKEALELLKNAISKAGYTDKIVIGMDVAASEFYREGKYDLDFKSPDDPSRYITPDQLADLYKGFVKNYPVVSIEDPFDQDDWAAWKKFTASSGIQVVGDDLTVTNPKRIAKAVEEKSCNCLLLKVNQIGSVTESLQACKLAQSNGWGVMVSHRSGETEDTFIADLVVGLCTGQ

SEQ ID NO: 24404 - protein, 373 aa, Pelusios subniger
VEVDLYTNKGMFRAAVPSGASTGIYEALELRDNDKTRFLGKGVSKAVGHVNKTIAPALISKNINVVEQEKIDKLMLEMDGSENKSKFGANAILGVSLAVCKAGAAEKGVPLYRHIADLAGNPEVILPVPAFNVINGGSHAGNKLAMQEFMILPVGAESFKEAMRIGAEVYHNLKNVIKEKYGKDATNVGDEGGFAPNILENKEALELLKTAISKAGYSDKVVIGMDVAASEFYRDGKYDLDFKSPDDPSRYITPDQLADLYKGFVKSYPLVSIEDPFDQDDWSAWKKFTASVGVQVVGDDLTVTNPKRIAKAVEEKSCNCLLLKVNQIGSVTESLQACKLAQSNGWGVMVSHRSGETEDTFIADLVVGLCTGQ

SEQ ID NO: 24405 - protein, 178 aa, Rosa hybrid cultivar
ECALWMPTRTALEQQLSYTLHQQNPVGHTVPIHLPVINQVFSSNHAVKISPNSPVARLRPRAGNHMPGEVVAVRVPLLHLSNFQINDWPELSTKRYALMVLMLPSDSARQWHMHELELVEVVADQVAVALSHAAILEESRRARDLLMEQNIALDLARREAETAICARNDFLAVMNHEM

SEQ ID NO: 24406 - protein, 179 aa, Rosa hybrid cultivar
ECALWMPCRSGMNLQLSHTLNYEAHIGSTVPFSLPIVSEVFKSSRAMRIPYTCPLVRIRPLVARYVQPEVVALRVPLLNLSNFQINDWPDVSAKSYAIMVLILPTDSTRKWRDHELELVDVVADQVAVALSHAAILEESMRASDQLVEQNGALDLARREAELAIHARNDFLAVMNHEMR

SEQ ID NO: 24407 - protein, 271 aa, Nicotiana tabacum
MDDYLNLFIEETSFYNRVVLGTFLPESWWGPLPHWFQGWLRNYIGGVLLYFISGFLWCFYIYRLKRNVYIPKDAIPSNRAMLLQIGVAMKAMPFYCALPSLSEYMIVNGWTKCFSRISDVGWLSYLIYMAVYLVIVEFGIYWMHRELHDIKLLYKYLHATHHIYNKQNTLSPFAGLAFHPLDGILQAVPHVVALFLLPEHFTTHIALLFIEAIWTANIHDCKHAKVWPVMGAGYHTIHHTTYRHNYGHYTIWMDWMFGTLRDPVEDEVKKM

SEQ ID NO: 24408 - protein, 93 aa, Homo sapiens
GVRNVASVCLQIGYPTVASVPHSIINGYKRVLALSVETDYTFPLAEKVKAFLADPSAFVAAAPVAAATTAAPAAAAAPAKVEAKEESEESDED

SEQ ID NO: 24409 - protein, 174 aa, Dendrobium grex Madame Thong-IN
MGRGRVEMKRIENKINRQVTFAKRRTGLLKKAYELSVLCDVEVALIIFSNRGKLYEFCSSRSMLKTLEKYQKCSDGAPEMTMTSRETQSSQVEYLKLKSQVEALQRSQRNLLGEDLNPLGGKDLDQLERQLEASLKQIISTRMQYMLDQLGDLQQRELLLFETNKSLGTRVSAL

SEQ ID NO: 24410 - protein, 217 aa, Silene vulgaris
MTIKVHGNPRSTATQRVLVALYEKHLEFEFVPIDMGAGGHKQPSYLALNPFGQVPALEDGEIKLFESRAITKYLAYTHDHQNEGTSLIHKEKHEMAAQLVWEEVEAHQFDPVASKLAWELVFKGIFGMQTDTTVVEENEAKLAKVLDVYEARLTESEYLGANDSFTLVDLHHLPLLGYLMGTQVKKLFEERAHVSAWCKKILARPSWEKTLALQKQS

SEQ ID NO: 24411 - protein, 403 aa, Arabidopsis thaliana
EESRSLNFALPSIFLEVKMVEQTQHPTILQKVSGQLLSSSVSQDIRGYASASKRPATYQKHAAYGNYSNAAFQYPLVAASQIATTTSPVFVQAPGEKGFTNFAIDFMMGGVSAAVSKTAAAPIERVKLLIQNQDEMLKAGRLTEPYKGIRDCFGRTIRDEGIGSLWRGNTANVIRYFPTQALNFAFKDYFKRLFNFKKDKDGYWKWFAGNLASGGAAGASSLLFVYSLDYARTRLANDSKSAKKGRGERQFNGLVDVYKKTLKSDGIAGLYRGFNISCAGIIVYRGLYFGLYDSVKPVLLTGDLQDSFFASFALGWLITNGAGLASYPIDTVRRRMMMTSGEAVKYKSSFDAFSQIVKKEGAKSLFKGAGANILRAVAGAGVLAGYDKLQLIVFGKKYGSGGA

SEQ ID NO: 24412 - protein, 340 aa, Lactococcus lactis
MDELSVKFGIVDDALEDLFKQIQDAGISIVDKDGNPSPLALVTDEIEKEEVSDTAMDEIVTNVRIDDPVRMYLKEIGRYPLISLDEETKLAEAIIAGGEGAEFAKQMLAEANLRLVVSIAKRYSGRGNQFLDLIQEGNMGLMKAVDKFDHTKGFKFSTYATWWIRQAITRAIADQARTIRIPVHMVETINKLIRVQRNLLQELGRDPSPEEIGKELHMAPDKVREVLKIAQEPVSLETPIGEEDDSHLGDFIEDDVIESPVDYTNRILLREQLDEVMDTLTDREENVLRMRFGLDDGRMHTLEDVGKQFKVTRERIRQIEAKAIKKLRHPRRSKPLRDFM

SEQ ID NO: 24413 - protein, 170 aa, Sus scrofa domestica
PKEQGFLSFWRGNLANVIRYFPTQALNFAFKDKYKQIFLGGVDRHKQFWRYFAGNLASGGAAGATSLCFVYPLDFARTRLAADVGKGAAQREFTGLGNCLAKIFKSDGLRGLYQGFNVSVQGIIIYRAAYFGVYDTAKGMLPDPKNVHIIVSWMIAQTVTAVAGLVSYPF

SEQ ID NO: 24414 - protein, 971 aa, Streptomyces lincolnensis
MPRGEIPLDPDGGPLFEFAARLRKLREQAGSPTYRDLARDAHYSIASLSSAAAGRQLPSLAVTLAYVRVCGGDEREWKLIWQRTADACTSACTGQGTSAETGPEDRRSGGAKPPYVGLAAFGEADAGVFFGREKLTGTLVEHLKEKRLLVLFGASGSGKSSVLRAGVLPAFPGVSSLVFTPAPHPLEECAVRLAARAGADPGQVRDGLTAEPPTFHRLVRRILAREQEAGSTADELLVVVDQFEEVFTVCRDPRERERFLAALLHAAQAPDSRTRVAIAVRSDFYTHCTRLPGLVDVLPHAHHPVGPMTVEELRAAIVKPAARSRLTVESALLTSLTADAHGRPGALPLLSHALLETWSRRRGNALTLAGYRAAGGFEGALAQTAEAFHHALGDSGRQAARRLFLRLVALGEGTEDTKRRVPRQELDDGPDTEFVLEQATRARLLTVDGDHVEIAHEALIRCWPRLGDWLEEDRDQERLRRALTEATTLWESLDHDPDILYRGVRLAAAKDLPRQALTTRERAFLDAGESAARQTQRREGRRLRRLRRLVGALVVLLVCAVAAAGFAVQAQSTITRQRNEAVILRAADEAVRLSPSNPSLAVPIALAAYRQAPQSRTRDALLSTLSIASTDPRPTGYTPAVTADGRTLAMADQSEIVLWDLSDPRQLRRLGAIDTREFALNGIEFTPHGDTLVGVGSDHVLRLWDVRDPRRPTLLCKRPTGHTEAVYSLALRHDGRLAATSGYDDVLHLWDITDPARPRRLDSLVGHTANVKPVAFSPDGRTLASGSDDRTIRVWDVTDPRHATPVAVLKGHRHFVDALAYSPDGRTLLSGSDDHTAKLWDISDLPRHRRLSDLVRHADIVAGVAFASHGRTAVTVGVDGGVNVWDVTDPARPAPLAHLTNPRGTVKEVRHLAAHGLFLTVTAHRSVQIWHTELDRALTDVCDRFHGTLTRAQWSRHFPRVDYSPPCPHRT

SEQ ID NO: 24415 - protein, 323 aa, Glycine max
AKGQTPLFPRIFGHEASGIVESVGEGVTHLKPGDHALPVFTGECGDCAHCKSEESNMCELLRINTDSGVMIHDGQSRFSKNGQPIHHLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEVNKAFDLMLKGQSIRCIIRMQE

SEQ ID NO: 24416 - protein, 355 aa, Sclerotinia sclerotiorum
MGACMSSNVEDTEQRKRSQRIDKTLEEDSKRLRRECKILLLGSGESGKSTIVKQMKIIHQNGYTVDELALYRLTIYKNLIDCAKALVGAMRQMEIEPTNPANKEYGSFLLEYIVDPDPHTPLNPRVGTAVASVWKDGSMERLLARQSEFYLMDSAPYFFEEAGRIAAHDYIPTEADVLRARTKTTGIYETRFTMGSLSIHMFDVGGQRSERKKWIHCFENVTSIIFCVALSEYDQVLLEESNQNRMMESLVLFDSVVNSRWFMRTSIILFLNKVDLFKQKLGRSPLENYFPDYSGGNDLNRAAKYLLWRFNQVNRAHLNLYPHLTQATDTSNIRLVFAAVKETILQNALKDSGIL

SEQ ID NO: 24417 - protein, 454 aa, Myxococcus xanthus
MPLRATLLPLLLPAVVVATLVALLDGPKEVFAAALVALAGSLMSLGVSRGTMQRQLDLLARHTRERAEGGASTAAPGVPERLDEVAGLEGAIDSLHAQLSARNAALTQEARTLTAVLDGMTEGVWVTDAEGTVVRHNDALRPLLASTNSPLTGQRPLALIRNEALHDAVMRACRESASSHLELTLDGHFPRTLSIRVTPLAKDLPGSAAVFHDVTELRRLEKVRKDFVANVSHELRTPITAIRGYAETLQGGALNDPVMAPKMVEIIHRQSERLSELVEDLLELSRLESREVSLKLARVTLADAAARAADTVRPKAGGKGQVVSLHVPQDLLAVGDPRAVEQVLLNLLDNAVKYTPAGGRVDVYGEYEQGRCVVRVKDTGVGIEAKHQSRIFERFYRVDKGRSRDMGGTGLGLAIVKHLLQAMDGEVKVESEPNGGSTFTIFLPLAASSSAATG

SEQ ID NO: 24418 - protein, 809 aa, Craterostigma plantagineum
MTTHEKAPASPCMRERVEETLADHRDELISLLSRYTSRGKCLLQSHQLMDELEDAIAEDPANKKLSDGCFNEVLSSAQEAIVLPPFVILAVRPRPGVWAYVRVNMQELSIDELTVSEYLCFKEELVDGRGFDPYVLELDFEPFNATFPRPSRSSSIGNGVQFLNRHLSSIMFRNKDSLEPLLDFLRVHSHKGHVMMLNDKIQRVSQLEYSLAGAEEYISKVPPDTPYSELESKLQGMGFERGWGDTARRSLEMMHLLSDILQAPDPSSLESFLGQLPMVFNVVVLSIHGYFAQTDVLGLPDTGGQVVYVLDQVRAMENEMIKRIKNHGLNITPRILIVTRLIPEARGTKCDQRLEKIDGCEHSHILRVPFRTEQGILKQWISRFDVWPYLEKFAEDAGKEIRAEMKAVPDLLIGNYSDGNLVASLLAYKMGVTQCTIAHALEKTKYPDSDIYWKKHEEKYHFSCQFTADLLAMQHSDFIITSTYQEIAGTRNVVGQYESHVAFTMPGLYRVVHGIDVFDPKFNIVSPGADESIYFPYTDKEKRLTNLQASIEKLLFDPEQNEEHIGVLKDRSKPIIFSMARLDRVKNITGLVEMYAKNKKLRELTNLVVVAGYNDVKKSSDREEKDEIEKMHNLIDQYDLNGSLRWISAQSNKARNGELYRYIADKRGIFVQPAFYEAFGLTVVEAMTCGLPAFATLHGGPHEIIEDGVSGFHIDPYHAEKAATRMADFFAKCDDDPSYWVKISEQALQRIRECYTWNIYSERLMTLAGVYSFWKYVSKLERRETRRYLEMFYILKFRNLAKSVPYATE

SEQ ID NO: 24419 - protein, 811 aa, Craterostigma plantagineum
  unsure (1)..(811): unsure at all Xaa locations
MATPKLTKIPSMRERVEVTLAAHRNELVSLLSRYVAQGKGLLQSHHLIDELENIILDDDAKKKLSDGPFSEVLRSAQEAIVLPPFVALAVRPRPGVWEFVRVNVYQLSVDELTISEYLRFKEELVDGGIDDNFVLELDFEPFNASFPRPTRSSYIGNGVQFLNRHLSSIMFRNKDCLEPLLEFLRAHKHKGHIMMLNDRIQHIPRLESALARAEDHLSKLPPDTPYSEFEYTLQGLGFERGWGDTAERVLEMMHLLSDILQAPDASTLETFLGRIPMVFNVVILSIHGYFGQANVLGLPDTGGQIVYILDQVRALENEMIKRIKAQGLSIIPQILIVTRLIPDAKGTSCNQRLEKISGCEHSHILRVPFRTEHGVLRQWISRFDVWPYLEKFAEDAASEISAELRGVPDLIIGNYSDGNLVASLMAHKMGVTQGTVAHALEKXKYPNSDIYWKXYEDKYHFSCQFTADLLAMNNSDFIITSTYQEIAGTKNSVGQYESHAGFTLPGLYRVVHGIDVFDPKFNIVSPGADDGIYFSYSEKERRLTSYHDCLEKLLFDPQQTEEHIGVLNDQSKPIIFSMARLDKVKNITGLVEMYAKNAKLRELANLVVVAGYNDVKKSSDREEIAEIEKMHSLIKEYKLDGQLRWISSQTNRVRNGELYRYVADTRGIFVQPAFYEAFGLTVVEAMTCGLPTFATSHGGPMEIIEDRISGFHIDPYHPEKAADLMADFFGKCNEDPSYWVKISEAALRRIQERYTWKKYSERLMTLAGVYGFWKHVSKLERRETRRYLEMFYILKFRELVNSVPYAVDGSD

SEQ ID NO: 24420 - protein, 502 aa, Glycine max
MDFTTPPIEDGFTAEKLFTQGFSYTYDDVIFLPHYIDFAADAVDLSTRLTRRLPLAVPFVASPMDTVSESAMAAAMASLGGIAVVHSNVPAAVQAAILRRAKSRRVPILSDPAFAAPSAVVEHDDAFGASPFLLVTDTGTSVGKLLGYVARSDWTNQTDKGLRVGDYMAPPPKPAPWNADLNKINEIMESEKSGAVALERDGEVVDLVVREEVERVRGYPKLVAPATVGADGEFMVGAAVGTREDDKERLEHLVKAGLNVVVLDSSQGNSIYQLEMVNYVKRVYPELDVIGGNVVTMYQAENLIQAGVDGLRVGMGSGSICTTQEVCAVGRGQATAVYNVSLIAYKSGVPVIADGGISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGASSLQSAHDLLRSRELRLEVRSGAAQVEGGVHGLVSYEKKYF

SEQ ID NO: 24421 - protein, 505 aa, Paracentrotus lividus
HNTYLTGDQVSSESSVEAYARCLRMGCRCLELDCWDGPDGLPIIYHGHTLTTKIRFYDVLKTIKEHAWVTTDFPIILSIENHCSLLQQRNMACLFQEVFGDNLLTQPIDRDATTLPEVSKLKRKIILKHKKLPDNGNETFTVPTEDSLDFDLRNSTKNGILLLEDPLDQEWAPHYFVLTDTKLYYSEETQTQANQDDHDDASSIEPVTPNEELHYSEPWFHGKLHTSGDEKPRVVAEEILNRYQQGDGTFLVRESETFKGDYSLSFWAMGKVNHCRIKSKLDRGQSKYFLVENMPFDSLYTLINHYRNVPLRSRDLEVRLMEPVPSPRPPVVHESKEWFHSRLSRHEAEDMLKRVPQDGAFLVRKSERESDAFAISFRADGKIKHCRIKQEGRLFTIGSAQFESLAELCGYYHKYPLYRKMKLKSPVNQEVVDRLGGEVDPADEEAIYGTGGIYMDPNQFVPKVTVKALYDYKAQREDELSFCKHAIITNVDKQDHGWWRGDYGG

SEQ ID NO: 24422 - protein, 485 aa, Sphingomonas paucimobilis
MAHFPQTPGFSGTLRPLRIEGDILDIEIEGEVPPQLNGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLQSQTFCAHPKIDPVTGNLCAFAYGAKGLMTLDMAYIEISPTGKLLKEIPFQNPYYCMMHDFGVTEDYAVFAVMPLLSSWDRLEQRLPFFGFDTTLPCYLGILPRNGDARDLRWFKTGNCFVGHVMNAFNDGTKVHIDMPVSRNNSFPFFDVHGAPFDPVAGQGFLTRWTVDMASNGDSFEKTERLFDRPDEFPRIDERYATRAYRHGWMLILDTEKPYEAPGGAFYALTNTLGHIDLATGKSSSWWAGPRCAIQEPCFIPRSPDAPEGDGYVIALVDNHVANYSDLAIFDAQHVDQGPIARAKLPVRIRQGLHGNWADASRLAVAA

SEQ ID NO: 24423 - protein, 329 aa, Sus scrofa domestica
LQVTVRDAINQGMDEELERDEKVFLLGEEVAQYDGAYKVSRGLWKKYGDKRIIDTPISEMGFAGIAVGAAMAGLRPICEFTTFNFSMQAIDQVINSAAKTYYMSGGLQSVPIVFRGPNGASAGVAAQHSQCFAAWYGHCPGLKVVSPWSSEDAKGLIKSAIRDNNPVVVLENELMYGVPFELPAEAQSKDFLIPLGKAKIERQGTHITIVSHSRPVGHCLEAAAVLSKEGIECEVINMRTIRPMDIETIEASVMKTTHLITVEGGWPQFGIGAEICARIMEGPAFNFLDAPAVRVTGADVPMPYAKILEDNSVPQVKDIIFAIKKTLNI

SEQ ID NO: 24424 - protein, 375 aa, Homo sapiens
MSTAGKVIKCKAAVLWELKKPFSIEEVEVAPPKAHEVRIKMVAVGICGTDDHVVSGTMVTPLPVILGHEAAGIVESVGEGVTTVKPGDKVIPLAIPQCGKCRICKNPESNYCLKNDVSNPQGTLQDGTSRFTCRRKPIHHFLGISTFSQYTVVDENAVAKIDAASPLEKVCLIGCGFSTGYGSAVNVAKVTPGSTCAVFGLGGVGLSAIMGCKAAGAARIIAVDINKDKFAKAKELGATECINPQDYKKPIQEVLKEMTDGGVDFSFEVIGRLDTMMASLLCCHEACGTSVIVGVPPDSQNLSMNPMLLLTGRTWKGAILGGFKSKECVPKLVADFMAKKFSLDALITHVLPFEKINEGFDLLHSGKSIRTILMF

SEQ ID NO: 24425 - protein, 375 aa, Homo sapiens [sequence omitted]

SEQ ID NO: 24426 - protein, 375 aa, Homo sapiens
MSTAGKVIKCKAAVLWELKKPFSIEEVEVAPPKAHEVRIKMVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAIFGGFKSKESVPKLVADFMAKKFSLDALITNILPFEKINEGFDLLRSGKSIRTVLTF

SEQ ID NO: 24427 - protein, 392 aa, Homo sapiens
MGTKGKVIKCKAAIAWEAGKPLCIEEVEVAPPKAHEVRIQIIATSLCHTDASVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIFGRCQEQFRILSD

SEQ ID NO: 24428 - protein, 368 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKW

SEQ ID NO: 24429 - protein, 374 aa, Homo sapiens
MGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 24430 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 24431 - protein, 297 aa, Homo sapiens
MGDHAWSFLKDFLAGAVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGRRAQREFHGLGDCIIKIFKSDGLRGLYQGFNVSVQGIIIYRAAYFGVYDTAKGMLPDPKNVHIFVSWMIAQSVTAVAGLLSYPFDTVRRRMMMQSGRKGADIMYTGTVDCWRKIAKDEGAKAFFKGAWSNVLRGMGGAFVLVLYDEIKKYV

SEQ ID NO: 24432 - protein, 298 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWRYFAGNLASGGAAGATSLCFVYPLDFARTRLAADVGKAGAEREFRGLGDCLVKIYKSDGIKGLYQGFNVSVQGIIIYRAAYFGIYDTAKGMLPDPKNTHIVISWMIAQTVTAVAGLTSYPFDTVRRRMMMQSGRKGTDIMYTGTLDCWRKIARDEGGKAFFKGAWSNVLRGMGGAFVLVLYDEIKKYT

SEQ ID NO: 24433 - protein, 370 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 24434 - protein, 473 aa, Homo sapiens
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 24435 - protein, 921 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGGMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSSELQEWRVACIAMEKTKQEQQASCTWFGKKKKQYKDKYLAKHNADLVTYEEVVKLPAFKRKTLVLLGAHGVGRRHIKNTLITKHPDRFAYPIPHTTRPPKRDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 24436 - protein, 465 aa, Homo sapiens
METGFPAIMYPGSFIGGWGEEYLSWEGPGLPDFVFQQQPVESEAMHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 24437 - protein, 432 aa, Homo sapiens
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFESPHTMDMSIVLEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 24438 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 24439 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 24440 - protein, 391 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 24441 - protein, 350 aa, Homo sapiens
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 24442 - protein, 113 aa, Homo sapiens
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 24443 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 24444 - protein, 335 aa, Homo sapiens
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 24445 - protein, 567 aa, Homo sapiens
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRCIWCQKTVHDECMKNSLKNEKCDFGEFKNLIIPPSYLTSINQMRKDKKTDYEVLASKLGKQWTPLIILANSRSGTNMGEGLLGEFRILLNPVQVFDVTKTPPIKALQLCTLLPYYSARVLVCGGDGTVGWVLDAVDDMKIKGQEKYIPQVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQECKDLNKKVELELDGERVALPSLEGIIVLNIGYWGGGCRLWEGMGDETYPLARHDDGLLEVVGVYGSFHCAQIQVKLANPFRIGQAHTVRLILKCSMMPMQVDGEPWAQGPCTVTITHKTHAMMLYFSGEQTDDDISSTSDQEDIKATE

SEQ ID NO: 24446 - protein, 791 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGGHAWTMKHFKKPTYCNFCHIMLMGVRKQGLCCTYCKYTVHERCVSKNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 24447 - protein, 928 aa, Homo sapiens
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 24448 - protein, 437 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 24449 - protein, 429 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 24450 - protein, 359 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQREPQAAREFILKMFVDLNPDSDKIIYSHFTCATDTENIRFVFAAVKDTILQLNLKEYNLV

SEQ ID NO: 24451 - protein, 374 aa, Homo sapiens
MARSLTWRCCPWCLTEDEKAAARVDQEINRILLEQKKQDRGELKLLLLGPGESGKSTFIKQMRIIHGAGYSEEERKGFRPLVYQNIFVSMRAMIEAMERLQIPFSRPESKHHASLVMSQDPYKVTTFEKRYAAAMQWLWRDAGIRACYERRREFHLLDSAVYYLSHLERITEEGYVPTAQDVLRSRMPTTGINEYCFSVQKTNLRIVDVGGQKSERKKWIHCFENVIALIYLASLSEYDQCLEENNQENRMKESLALFGTILELPWFKSTSVILFLNKTDILEEKIPTSHLATYFPSFQGPKQDAEAAKRFILDMYTRMYTGCVDGPEGSKKGARSRRLFSHYTCATDTQNIRKVFKDVRDSVLARYLDEINLL

SEQ ID NO: 24452 - protein, 355 aa, Homo sapiens
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 24453 - protein, 381 aa, Homo sapiens
MGCLGGNSKTTEDQGVDEKERREANKKIEKQLQKERLAYKATHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 24454 - protein, 359 aa, Homo sapiens
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKINYSHFTCATDTENIRFVFAAVKDTILQLNLKEYNLV

SEQ ID NO: 24455 - protein, 394 aa, Homo sapiens
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 24456 - protein, 355 aa, Homo sapiens
MGCRQSSEEKEAARRSRRIDRHLRSESQRQRREIKLLLLGTSNSGKSTIVKQMKIIHSGGFNLEACKEYKPLIIYNAIDSLTRIIRALAALRIDFHNPDRAYDAVQLFALTGPAESKGEITPELLGVMRRLWADPGAQACFSRSSEYHLEDNAAYYLNDLERIAAADYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLTICFPEYKGQNTYEEAAVYIQRQFEDLNRNKETKEIYSHFTCATDTSNIQFVFDAVTDVIIQNNLKYIGLC

SEQ ID NO: 24457 - protein, 128 aa, Homo sapiens
MAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 24458 - protein, 103 aa, Homo sapiens [sequence omitted]

SEQ ID NO: 24459 - protein, 98 aa, Homo sapiens
MSVRGKAGKGLGKGGAKCHRKVLSDNIQGITKCTIRRLARHGGVKRILGLIYEETRRVFKVFLENVIWYAVTNTEHAKRKTVTAMAVVYVLKRQGRTL

SEQ ID NO: 24460 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADRIIVAKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 24461 - protein, 360 aa, Homo sapiens
MENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVASSSASGWATASSTSPCSTPCSMPGTSVAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 24462 - protein, 514 aa, Homo sapiens
MADYLISGGTGYVPEDGLTAQQLFASADDLTYNDFLILPGFIDFIADEVDLTSALTRKITLKTPLISSPMDTVTEADMAIAMALMGGIGFIHHNCTPEFQANEVRKVKNFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVFHSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDPMEKSSSSQKRYFSEGDKVKIAQGVSGSIQDKGSIQKFVPYLIAGIQHGCQDIGARSLSVLRSMMYSGELKFEKRTMSPQIEGGVHGLHSYEKRLY

SEQ ID NO: 24463 - protein, 514 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPRSITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 24464 - protein, 320 aa, Homo sapiens
MEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQELSLQDVRKEINFCRKVKLPIIGVVENMSPFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 24465 - protein, 790 aa, Homo sapiens
MSRRRHSDENDGGQPHKRRKTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 24466 - protein, 274 aa, Homo sapiens
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 24467 - protein, 231 aa, Homo sapiens
MAGKKVLIVYAHQEPKSFNGSLKNVAVDELSRQGCTVTVSDLYAMNFEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 24468 - protein, 461 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 24469 - protein, 187 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 24470 - protein, 523 aa, Homo sapiens [sequence omitted]

SEQ ID NO: 24471 - protein, 359 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFLPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 24472 - protein, 406 aa, Homo sapiens
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 24473 - protein, 290 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHGPFVMNTNEEISQAILDFRNAKNGFERAKTWKSKIGN

SEQ ID NO: 24474 - protein, 1022 aa, Homo sapiens [sequence omitted]

SEQ ID NO: 24475 - protein, 480 aa, Homo sapiens
MIRAAPPPLFLLLLLLLLLVSWASRGEAAPDQDEIQRLPGLAKQPSFRQYSGYLKSSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 24476 - protein, 422 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 24477 - protein, 365 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 24478 - protein, 557 aa, Homo sapiens
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRGFGALAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGAQSTPARPPTTPSAACLPRPPPPGPGGRRRQPPVRPGRVHLPRPEALHQARGPAGQ

SEQ ID NO: 24479 - protein, 721 aa, Homo sapiens
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEEDRQELLSVIPVYIRNDMTEPHKPLTQLLPGISREALDFLEQILTFSPMDRLTAEEALSHPYMSIYSFPMDEPISSHPFHIEDEVDDILLMDETHSHIYNWERYHDCQFSEHDWPVHNNFDIDEVQLDPRALSDVTDEEEVQVDPRKYLDGDREKYLEDPAFDTNYSTEPCWQYSDHHENKYCDLECSHTCNYKTRSSSYLDNLVWRESEVNHYYEPKLIIDLSNWKEQSKEKSDKKGKSKCERNGLVKAQIALEEASQQLAGKEREKNQGFDFDSFIAGTIQLSSQHEPTDVVDKLNDLNSSVSQLELKSLISKSVSQEKQEKGMANLAQLEALYQSSWDSQFVSGGEDCFFINQFCEVRKDEQVEKENTYTSYLDKFFSRKEDTEMLETEPVEDGKLGERGHEEGFLNNSGEFLFNKQLESIGIPQFHSPVGSPLKSIQATLTPSAMKSSPQIPHQTYSSILKHLN

SEQ ID NO: 24480 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 24481 - protein, 257 aa, Homo sapiens
MYEQLKGEWNRKSPNLSKCGEELGRLKLVLLELNFLPTTGTKLTKQQLILARDILEIGAQWSILRKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFTEATRILFFNTPKKMTDYAKKRGWVLGPNNYYSFASQQQKPEDTTIPSTELAKQVIEYARQLEMIV

SEQ ID NO: 24482 - protein, 317 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 24483 - protein, 367 aa, Homo sapiens
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNNMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 24484 - protein, 282 aa, Homo sapiens
MSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 24485 - protein, 509 aa, Homo sapiens
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAEAMGPYVFLLFAVLLLGFFIFTFLRVPETRGRTFDQISAAFHRTPSLLEQEVKPSTELEYLGPDEND

SEQ ID NO: 24486 - protein, 299 aa, Homo sapiens
MMGKEEEIARIARRLDKMVTKKSAEGAMDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 24487 - protein, 237 aa, Homo sapiens
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWPFQANLYVGLVVMCGFVLVDTQLIIEKAEHGDQDYIWHCIDLFLDFITVFRKLMMILAMNEKDKKKEKK

SEQ ID NO: 24488 - protein, 623 aa, Homo sapiens
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 24489 - protein, 520 aa, Homo sapiens
MSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTLLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 24490 - protein, 246 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 24491 - protein, 246 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 24492 - protein, 245 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 24493 - protein, 478 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 24494 - protein, 417 aa, Zymomonas mobilis
MSSFLNGKRILLVISGSIAAIKAPDIIRLFRKKKADIRCLITKGGANFITPLALASLSGNPVAQDMWDESEEASIRHIRLAREADMIIVAPASADFISKMAHGLANDLASTVVLAADSPILVAPAMNHRMWHHSATQRNIHQLKSDGISFVDPEAGAMACGETGIGRLAAPEDILLSAESLFAEEQNHQFLKNRHFIVTAGPTHEPIDPVRYLANRSSGKQGFAIAEALQKLGAKVTLVTGPVYQNTPDRVERVNVETAIEMEKAVENALPADGAIFTAAVADWRFNYSPSKYKKGRSEPELIPIEKPEILSNISKRKIDRPSLVVGFAAESENLLENAKVKLQQKGCDWIIANPVIESEDAPSAMGGDYNKIFIASHAGIENWPLLSKKEVASRLASKIADYFNLINEHPSSIISK

SEQ ID NO: 24495 - protein, 488 aa, Bacillus halodurans
MAHTVSEQRIHEVGSMKRDHYRMVINGERVDSDETFETFNPAKGEILATVAKASREHAEKAVQAARHAFDHGKWRKYPVGKRARVLNQIAAIMRERFQELVEIEVLNSGKAISAAQPQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYIGR

SEQ ID NO: 24496 - protein, 339 aa, Hordeum vulgare subsp. vulgare
MENILHATPAPVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 24497 - protein, 166 aa, Nicotiana tabacum
MDSSKAFLYLVFFLFSLHFFTVFATEFAVGGDKGWAVPKVKDDQVYDQWAGKNRFKIGDTLSFEYKKDSVLVVTKEEYEKCKSSHPIFFSNNGKTIYKLEQPGLYYFISGVSGHCERGLKMIIKVLEPESPPQSANQTSPTSSGTTAAATPTTMAFVVSLFGALLY

SEQ ID NO: 24498 - protein, 689 aa, Octopus dofleini
MADLEAVLADVSYLMAMEKSKSSPAARASKKIVLPDPSIRSVMHKHLLKNGVVTFEHIFDQRIGYLLFKDFCNNGSDVPIAEINFYEEIKKFQTMDTDEDRIKQARDIYDQFIMRELLAQCHEYTKTAINNVQDALTKARKTKQLGNHVFNKYKDEIRKKLNKEEFNKFLESDRYSRYLQWKNLELNINLTMNDFSVHRIIGRGGFGEVYGCRKADTGKMYAMKCLDKKRIKLKTGETLALNERIMLSLVSTGECPFIVCMTYAFQTPEKLCFILDLMNGGDLHYHLSQHGVFSEQEVRFYAAEVILGLEHMHVRGVVYRDLKPANILLDESGHVRISDLGLACDFSKKKPHASVGTHGYMAPEVLAKGVAYDSSADWFSFGCMLYKLLKGHSPFRQHKTKDKHEIDRMTMTMNVELPDSMSVEMKSLLEGLLKREVEERLGCGGKGAEELKENDFFKDLDWNQVYQLHYTPPLIPPRGEVNAADAFDIGSFDEDDTKGIRLSESDQQLYENFTLTVSDRWQQEITETVFDTVNAETDKLELKKKPKREDQIEKDVIVEGEILKLGGPFLNSWQKRHLRLYPNRLEFYQKNRDGGIQKNKVELITMYDIKEVCQEFQKLNKTDNCIVMVLKNETKLVITSPDKVIINQWKEEILGGYRASTKMQSKMNKKASKLYGADVPIEHRNSNGS

SEQ ID NO: 24499 - protein, 506 aa, Oleomonas sagaranensis
MIHQTIEEISKSIAFRSRYDNFIGGKWVAPVRGQYFDNITPITGMPVAQIARSTAEDIELALDAAHAAKDAWGRTSVAERARLLNKIADRMEEKLDLLAMVETIDNGKPIRETKAADLPLAIDHFRYFASCVRAQEGSIGEVDHDTMAYHFHEPLGVVGHIIPWNFPLLMACWKLAPALAAGNCVVLKPAEQTPLSIMVWADLIGDILPPGVLNIVNGFGIEAGKPLASNKRIAKIAFTGETTTGRLIMQYASENLIPVTLELGGKSPNIFHEDVAAEDDDYFDKAIEGFVLFALNQGEVCTCPSRAIIHEKIYDKFMERALARVAAIKQGSPLEAATMLGAQASNDQLEKILSYIDIGKAEGAELLIGGERNILGGELAGGYYVKPTVFRGNNKMRIFQEEIFGPVVSVTTFKDEAEALSIANDTLYGLGAGVWTRDGNRAYRFGRAIQAGRVWTNCYHLYPAHAAFGGYKQSGIGRETHKMMLDHYQQTKNLLVSYSPKALGFF

SEQ ID NO: 24500 - protein, 291 aa, Nicotiana tabacum
MNDDDALTSNWNDIMLDTGIADAEPKMQYQEQKQPSNFPVHQGQPLQQVPTASVETSAIVPASSTASGASSKQRMRWTPELHEAFVEAVNKLGGSERATPKGVLKLMKVEGLTIYHVKSHLQKYRTARYKPEALEGSSEKKESSIGDLSALDLKTGIEITEALRLQMEVQKQLHEQLEIQRNLQLRIEEQGRYLQEMFEKQCKSIPSTDLVKASSSIAEDASAQSTDAVQRSSNKNDPAVPPSNPQEAGDYITQKVGEKQKEQEREDLGNLETNNSSSSNTPPTKRAKLDE

SEQ ID NO: 24501 - protein, 581 aa, Pseudomonas aeruginosa
MSDSCLPIAMVQSAQSHRPGTKPEIPALMQTVYTVLTLLLVVGATRLAAQLLPLPLPLIQIAAGALLALPSLGLHIALDPELFLFLFIPPLLFVDGWRIPKREVWGMRWPILMMAFGLVFFTVVGAGYFIHLLIPEIPLAASFALAAVLSPTDALAVSAITQGRLPKRLMHLLEGEALMNDASGLVAFKFAIAAAMTGVFSLVDASLNFLVVAVGGLAIGVFLSWSLGRIRAWMISRGWDDPATHVVLMLLLPFASYMVAEHLGVSGILSAVAAGMMQSWVDLLPRQTSTRLLNRSVWSMLEFAFNGVVFLLLGLQLPDIMKSVANHHGDLLWRSSLLLAYVAAITAVLMLIRYGWVYGYWKLSLRIDRWRGKSPPGLSGISLRRLSALSALSGVRGAVTLAAVLSVPMSLMDGSAFPQRDLIIFIATSVILISLIGATIGLPLLLRGLPASNNGAHERERREAWRKTAEAAIRALESEELPQVEGNDAANTSRVAEARAQIMAEYRQSLDTAPTTDEARDQAQALEIADKALRLKALRAQRLELYRQRRNNEIDDETLGDILRELDQQESWLTNRFARWV

SEQ ID NO: 24502 - protein, 1355 aa, Ephydatia fluviatilis
MAGHVSKRVLKQPDVQSILLSGVSFWKWEDGDQVAQKAEFFADKDAHFLYAKPEDKSKYNIIWDVTHISDVRAGKVPYKDSKLHEFLRSMTSSDYLEPEQFLTMVYRREGIVNLDHVQLMAPSMDVAEKWKRAVNAIVFNMLRFNASTLTFFKRNYQRILLSCNGYGQIPVKSICRALLLRVRDKTDMELFGIFDAQKKKMDDGTEYIQDTDFTWDKYEQLVNQLTKGRTSDMECVIKDLGKSKKHQQLTLQEFHNFLTKCQRDPRLNTILYPPPTKQQAKELAEKYEGKAVEDRLTPRALLNFLMSEDNNVLGVENLDQFMDMTQPLSHYFINSSHNTYLTGHQLRSLSTVEMYRQCLLLGCRCVELDLWPEGEDIIITHGGTLCTKIPFKDVVEAISEYAFITSEFPVILSIENHCRHKPLLIQKIASTFALVFGDKLQKSPLDDYPLEPGLPLPSPERLKGKILIKDKVKKSKGIESSTGTLPRGAHLTSEDKAETLSRKSGTGDKVSDGNGGQATPTSKEFVMPSVALTSLSASSLVVKDKMDIANLREIVPLPESPLETSPGPRKTSPGLTETCPGSPGPIKTSPGPVDTSPSSPLHVVPTCTWSGLTTPSSANAGGPPGTSTELPLPESTPPPPLPPPSETTPFNLETVPIPGTPPPSSGVNRTEEIQDNESCPLSPLDTSTAPDPNIPTDSPKETAPHPVTPVNSLKETAFQNRSLKKTFSGMTEDSMESTPRKEEEFVYNMTPARPSEGEAFVTGPLVDIINYCSGITFEGFEAAEKTNCSFYQSSFNEDKGVSLVKVTAREFVKYNMRQMSRIYPQGGRINSSNYMPQIFWNVGCQLVALNFQSTDLPIQLNNAKYEFNGVTGYLLKPAAYLKERTTGGLFNPFIQNPVENIVPATLTLKVISGIFLTEKRTNCLVEAQMFGLPSDTVNHKFYTTKKEAPHPVWDHEPFTFAKILLPEMAMLRVAVYDEDRELLGQRSLPVNAIRAGYRHIPLRDKYNQPLSLASLFVHIMVDDWVGSDMEAIIAGLMDPIAFVNSALAELAIGTENEDQDPSLLSGSSTLPRTRKPENTDARKDSTTTVASPFPPSASFDQKVDAATIPSSPPVGSTAAAASSMAAPETKSLTLNYPKAKVDDVLPIVQMVTKRPPPVAAQHVDDCIAFHESILKIEKKMVTDRMKVLKKHEKHLSDHGSKQSKGKQEEVASRIAALKDDHSKELLALDKKLLHERNVKLETLLNEAHKKEMKDLIAQHRSEINSVSSELIMFLKRRDSDTKGRMAFDERTIAVGTKNKGELEKLHQKEKENLEKSQKEAKERLQKEYEESLNKLEHPKGTSGSPEQTKEEATAM

SEQ ID NO: 24503 - protein, 1283 aa, Ephydatia fluviatilis
MSQIPGAVSGADIGTILGALERGTVMVRFPARKRRPEKKLFCLKVDTFEVVQYPLTKGTRTVAEESIDIREIKEVREGVSSKDFERQPDETKKVDQYCCFVIYHGTEFRLTTLSVAALCRDECDAWVKALKHVTLAGNFASHLLTHRWLNKEFLALEPSGDNLTIGPIELKKYVLRISSKALLNKARQLFIDFDYSRAGRMGVEDFFNLYHNTIHVKTIGERFYPFCADRQSLTFSEVQMFFREEQKDKRADDTVYLAGLIREYARVPNRTVRDPRLPSLLLPEFVNFLFSKQNSVFAEEYAQIYQDMDRPISHYWIASSHNTYLTGNQYSSESSCECYSRALRMGCRCIELDCWDGPDGNPIIYHGRTLTSKIRFIDVIKTIKDHAFVTSEYPIILSIEQHCDIQQQRIMARQFKEVFGDALLTELVDLNATRLPSPNALKRKIIIKHKKLDGTEETSGNNKPEEAGEEEGVTFNSDLCNSILNGLLFMQDPIDKNWAKHYFVLTEDKLYFTDQQEKDEDEADKTETNTETLPSTEQHLKEKWFHGKLAGGRVAAEKLLTDYKDVNGAFLVRESTTFTGDYSLSFVRDGKYNHCRIHTKSEGGKTRFYLIDQTLFDSIYELIMHYKSNPLKSPTFEQVLAEPVPQQNSHLGKAWFHENLSRSEAEEMLKKVRMDGAFLIRPSEQNTKAGQKNYAISFRAEGKVKHCRIEVDESGQYCIGSAIFDSLTELVQYYEANPLYRRMRLKYAINEDLLKSLGEAESDDVYYHPIYYTFNEEKATPITCKALFDYTAVRPDELSFCKDAVITNVEKHGGGWWKGDCGNKNQKWFPANHVEEVQADEVTEDRQLGNLQQGAIDISGCTTEIHHLSSNNLYALKIVPMLKAESTELEKENHMGLMVAAQSLEEILRWQKAIDEARNKANSHALAQMEKEKERKKDEQKKRIAIEMSDIIAYCRPVPFDENKMNDMGKYYNMCSFVETRVEKIVHNKSLAAQFLVHAHTYLNRVYPKGQRLDSSNYDPVPMWNGGCQMVSLNYQTGDKSMQLNEGKFLQNGKCGYVLMSDCMFEPGFNPLDISTQKTSPITLSVQIIGGRHLLRQGRGMTCPLVEVEVIGVEVDYNKYRTSTCKENGFNPVWNEGCDFDINNPALALLRFTVLDEDAFGDANFLGQAVFPVLCLRTGYRSVPLRNAFSEELELCSLLVHLEMRSAVEEGEELYCTIRSLREDITRMSKQFQHMVREDPATSCDQLAEIIQEKQMQLRKLNSARARKPGQAKPALSHITIPR

SEQ ID NO: 24504 - protein, 1012 aa, Hydra magnipapillata
MAGAGPISETLPVISVPPMLVNGGRFLKWDDQDLTCAIYILEVDKLGHVLSWKPKDFSKDTEVLELVLVRDVRTGQYAKIPKAQDTRARDAIKMYSAVELESNLMQERTITIVYGSNFVDLTFINFVASSVSEAQEWTEALFKCTNNLLEFHSSPLKCLERFYTRICVQKNQNGEIPVKILVKAFVNHKEDIKRAYGTLQSLGIAHGKKDMIVLKDFSFETFFTFYNRLISRHDFDNVFTELGAKNKPYLTTDQLVEFLNNRQRDPRLNEILFPYYNINAADAIVNTYEPNKSFADKGLISIDGLMKFLMSNDANVLLPGKLNIHQDLSFPIAHYFINSSHNTYLQGHQLTGKSSVEIYRQVLLAGCRCIELDCWDGKTEEQEPVITHGMTLCTEVLFKDVIEAIKESAFKTSEYPVILSFENHCSAKQQMKMANYCLQIFGDLLLNKELDEYPLLPGTLLPSPKVLKRKILIKNKKREIKDTKNANISTQSVDLNSSGRFEPEVLNIEEIPEDAEDLSKSEEEEAPEVEAQQELSELVNYFQPVHFRGFEKAEKRKCYYEMSSFGENTATNLLKEQPVEFVNYNKFQNSRIYPKGSRVSSDNYIPQLFWNAGCQMVALNFQTLDVPMQLNLGKFEINGRCGYLLKPEHMRRHDLTFDPFVDSTVDGIIAGTVQVKVISGQCLLERRSGTYVEVEMYGLPADTVRRKYRTKVVSNNGLNPVYDEDPFKFKVILPHLAELRIAVYEENGKMIGHRILPVDGLLPGFRHIKLRNESYQPLCLPTLFVDIVTKDYVPESFSDFADALSNPMKYLSEKEKRTQQLEAFEFEESDSTALQVPTTNKNILKVTVQEPQNLVKHGSKISLQADSYQGQKDKYVAEPMKQTKRKRSQSQSLGRLESPKQPIRRTFSTPKLLGEDTSSDYLKISGLSINTLKEHKLYKKWKLKFDSDFLNLMQKQAKGRIQCRKEIEAKTKKLTLNLEKKNQLYKRIKTNFLKQQKLMEIIMKYTITVQLK

SEQ ID NO: 24505 - protein, 1364 aa, Hydra magnipapillata
MQNKFFNAIEINDKVKEVFQKGVYVKKLEEDKSSISTCLLKIDAFGFFLSYQEKDKDAFCIDICDISYVKDGATPKALNKVFEQYSDEEKNNVDFLSRFTYICFGTNIVEVSFITFDFMTKELKQIFFSCISTNLTNHKHAFRNPSVKQMLYKQYVLSKSMVNASGKISMKNIFKCLNAVRFEQTTIEGIQTALSLPVGEIDPEMFSFEQFYKLCCLVCPRPDIDELFISLFGTRLTAEKLMKFLNEDQRDPRLNEQMHPHCTISNAVDLIMDYESNEACRTKELLTIQGFIQLLLSKESAVLNPECLLLRHDMNQPINHYFINSSHNTYLLGRQVYGKSSVEIYRQVLISGCRCIELDCWDGPGVPIITHGKAMCTNVLFSDVVQAIADTAFLTSPYPVVLSFENHCSLPQQKILAEMCIKIFGPLLLDKPLESNPLEPGIELPSPEQLKYKILIKNKKLASNDEMQFSNGKLNSSANISYDIPVEMPETNTSSYSSCDVPDLESESEMEHDNCFNEDDLSRMVTEDNFETKLNEKMDQFAKQVYSESSSNNQPVMRRRSTQEFNLKKYKLSKIAENCVVDDSEDEIILTKFGSNPCIASALNEEVNSNTTTSVLECEDNSSHFPSKWRSHSVAPLNQSETEAVDIKRRAISDISDIETSKKVSSMSTVMSNLPDNSIITSVSGKVDPLLSSLINYVQPQSFKGFEYAEEQKKHYIMSSFSELEGLKQCTENLTDFVLYNKRQFSRIYPKATRVESTNYVPQVFWNAGCQFVALNLQTPDLSVQLNQQKFECNFNCGYLLKPVKYRETDSNFDPLTENPIDGIIPLTVEIEVISGQYLSEKKCMTYVQIDMFGLSADTTRKKRTNLSESNLMNTVYPKTVFKFDKIVFPEMVLVRFTVYDESDKLLGQRVLPLEGIKSGYRHIAMRTETGHFLPLTTLFVKFTFKIYIHEKYEDAVEELFNPNKYKLLAEHRASRIAKKLEDMLLSDEDIIVQNPKLIQICGDQANSTPTETKRKSSVSSMGSSLNHPSLITSNTIDNSSIKMKSFSLTFDESNNGNRMLELCEDEFLKERKIDDFKLDKMFLRIAKKNGKEVDILKQNHRKERKLTESFYDEEISKLQMYYDKTLESELKSFEKSLQKINTKEVQASYQKIVEDVSIKFDKSSRKIIDSQMMELKEKYLEKTKIWKTEKVGKISVIVEEQKKALKIMIDEHIEKEARIKYSHSIQQIDLIGKLLKTAQDNDIKKLAEINEKELSDLTKAQARDSIQSIKDLEKEFENSKMDRINKEKIKRERDKLRIEEFGMQRRKLVQNQQKRQEKLIEKHKNENKQFEDHRKEIIQLGYEPIIRHIRQAQTLISLHQQKL

SEQ ID NO: 24506 - protein, 738 aa, Hydra magnipapillata
MTQEYEKTPNPENIDEILVHLSSGCNVRKINLSKTRKVVSKKYLVLDEDKTAFRYKPSVKGSNFKILIADITDINVAESFETKICFKKKLLHQFIVTYKDDENKTHKLGFFVEDQNEVRFWSSGLQYLSDELKKPEDPIVDDWLREAFDAADVNKNSLLGLKEISQLLNSLNISKENSDVKLKFQECCNEEKNNENGKLTRNGFAEFFKFFSFDKNEVSSIIKEYGRTIFGKTCLNAESLQKYFREVQQQNLSLEECKKIISKHDENRGSYLSAEGVIRMLISEENDILDPIHKNIHQDMTRPLTDYFINSSHNTYLLNDQVLGMSSTKAYEKALKKGCKTLELDCYDGENNEPIVYHGFTLTSKILFKDVIDTIAMGAFVQSEYPVILSFENHCSPEQQIVMAQHLKEKLGKMLFDGDVDLNQTKLPSPETLKGKIFIKAKKIQNTEVTDDDTSETSLKNRQSKTKQKINVAKEFSNIINYVESITFKSLDEGLATQKYFQNVSLGEKKLLQLGRDEPKKLIEYSNKFLVRTYPKGSRIDSSNYNPTKGWVYGCQIVALNFQTPGEMMDINDGMFALNGKCGYVLKPECLRSGNFDPQNIDKSINGVCKVFIKIISGHLLPKASKDETIPDPYIRINIHGIPKDEVLGKFITKKVKRNGFNPQWNEDFQFDLYAPELAHIRFALCDSDMGVDDFIGQYSIPFSAIRTGYRRVPLLKRSGHPIKNASFLVFIQKSLAK

SEQ ID NO: 24507 - protein, 331 aa, Schizosaccharomyces pombe
MNQTEAAPVVSVSRVYAHVNEEMPREYWDYENMQEVFGYQDNYEIIRKVGRGKYSEVFEGLNVLNNRKCIIKVLKPVKYKKIKREIKILQNLAGGPNIISLLDIVRDPESKTPSLIFEFVDNIDFRTLYPTLSDYDIRYYLYELLKALDFCHSRGIMHRDVKPHNVIIVHKKRKLRLIDWGLAEFYHAGMEYNVRVASRYFKGPELLVDFREYDYSLDIWSFGVMFAALIFKKEPFFRGRDNYDQLVKIAKVLGTDELFAYVQKYQIVLDRQYDNILGQYPKRDWYFVNRDNRSLANDEAIDLLNRLLRYDHQERLTCQEAMAHPYFQVLK

SEQ ID NO: 24508 - protein, 231 aa, Schizosaccharomyces pombe
MQLYSSESESDDSQYWVDWFLGLKGNEFFCEVDEDFIQDRFNLTGLSHEVPHYSQSLDLILDVLDPDLPEEVQDEVEASARHLYGLIHARYILTAQGLYKMLEKYKKCDFGHCPRVLCNGQPMLPVGLSDIAHAKSVKLYCPRCEDVYTPKSQRHASIDGAYFGTSFPHMLFQVYPELAVPKSQERYIPRIFGFKVHSYSATFKKQDVYKEKQKKRLQGAEAESKNKLAIT

SEQ ID NO: 24509 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHSVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 24510 - protein, 187 aa, Pisum sativum
MEFKATELRLGLPGITEEEEKKIIHGSSVVKNNNKRQLPQTSEESVSISKVTNDEHIVESSSAAPPAKAKIVGWPPIRSYRKNSLHEADVGGIFVKVSMDGAPYLRKIDLRVYGGYSELLKALETMFKLTIGEYSEREGYKGSEYAPTYEDKDGDWMLVGDVPWDVTSCKRLRIMKGTEAKGLGCGV

SEQ ID NO: 24511 - protein, 422 aa, Streptococcus pneumoniae
MALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 24512 - protein, 601 aa, Saccharomyces cerevisiae
MLNHPSQGSDDAQDEKQGDFPVIEEEKTQAVTLKDSYVTDDVANSTERYNLSPSPEDEDFEGPTEEEMQTLRHVGGKIPMRCWLIAIVELSERFSYYGLSAPFQNYMEYGPNDSPKGVLSLNSQGATGLSYFFQFWCYVTPVFGGYVADTFWGKYNTICCGTAIYIAGIFILFITSIPSVGNRDSAIGGFIAAIILIGIATGMIKANLSVLIADQLPKRKPSIKVLKSGERVIVDSNITLQNVFMFFYFMINVGSLSLMATTELEYHKGFWAAYLLPFCFFWIAVVTLIFGKKQYIQRPIGDKVIAKSFKVCWILTKNKFDFNAAKPSVHPEKNYPWNDKFVDEIKRALAACKVFIFYPIYWTQYGTMISSFITQASMMELHGIPNDFLQAFDSIALIIFIPIFEKFVYPFIRRYTPLKPITKIFFGFMFGSFAMTWAAVLQSFVYKAGPWYNEPLGHNTPNHVHVCWQIPAYVLISFSEIFASITGLEYAYSKAPASMKSFIMSIFLLTNAFGSAIGCALSPVTVDPKFTWLFTGLAVACFISGCLFWLCFRKYNDTEEEMNAMDYEEEDEFDLNPISAPKANDIEILEPMESLRSTTKY

SEQ ID NO: 24513 - protein, 528 aa, Chlamydia trachomatis
MTQTAEKPFGKLRSFLWPIHMHELKKVLPMFLMFFCISFNYTILRDTKDTLIVTAPGSGAEAIPFIKLWLVVPSAVVFMLIYAKLSNILNKQALFFAVLSPFVVFFALFPVVIYPCRHILHPTAFADTLQSILPSGFMGFIAMLRNWTFAVFYVLSELWGSVMLSLMFWGFANEITKISEAKRFYALFGVGANVALLISGPAIIWSSKLRASLGEGVDPWGVSLYFLMAMFLCSCAIIAACYWWMNRYVLTDPRFYNPAELKAKKSKPKMSMGESFSYLLRSPYMLLLALLVICYGICINLVEVTWKSQLKMQFPNPNDYSAFMGNFSFWTGVVSVFVMLFIGGNVIRRFGWLTGALVTPIMVLVTGAVFFALVIFRDHATGLVAALGTTPLMLAVVVGAIQNILSKSTKYALFDATKELAYIPLDQEQKVKGKAAIDVVAARFGKSGGSLIQQGLLVVCGSIGAMTPFLAVALFAIIMVWLTSATKLNKLFLAASAAKEQELAEAAAAEKEASSAAKESAPAIEGVS

SEQ ID NO: 24514 - protein, 540 aa, Chlamydia trachomatis
MSSEVKSFSKFRGYFFPIYRSEFSKFIPLFFLAFFVGVNYALLKTTKDSLVLVGSRAGAEVIPFLKVWGIVPGAVIVTMIYGWMSRRYSRGTVFISLVGGFLGFFALFATVIYPIGDALHLNKLAAKLQSILPPGGRGFVVMVQYWSYSLYYVMSELWSSVVLSTLFWGVANHITSVREAGRFYALINTGLNLSSVFAGEVSLWLGRSPVIAFPMAVDPWHEMLLNITLLIVLAGGVILYLYQKLDRLMDETSMLEEGLAAEMSVAQLKKEKKRSKAKAKSLFALLLRSRYLLGIAVVVLSYNLVIHLFEVVWKDQVCRIYASRVEFNSYMSRITTLTGIVSALAGIFAAGQTIRRWGWTVGALVPPLTILITGALFFGAIYAVKGDAMIFGGILGISPLVLTAWLGGVQNVFSRAIKFTYFDQTKEMAFIPLEDDEKNYGKAAIDGVISRVGKSGGSLVYQGLLIIFSSVAASLNAITIVLLLALGSWIFVIAWLGREYTAKTETLVRVNASEEDVLQEEREASSLVDAESREEPVTTL

SEQ ID NO: 24515 - protein, 355 aa, Mycobacterium leprae
MTAEGDGSFKPGPPTERRGEAPDRNLAMELVRVTEAGAMAAGRWVGRGNKEGGDGAAVDTIRELVNTVSMRGVVVIGEGEKDHAPMLYNGEEVGNGDGPDCDFAVDPIDGTTLMSKGMPNAISVLAVADRGAMFDPSAVFYMNKITVGPDAAHVLDITAPIGENIRAVAKVKDLSVRDMTVCILDRPRHAQLIDDVRATGARIRLITDGDVAGAISACRPQSGTDMLAGIGGTPEGIIAAAAIRCMGGAIQAQLAPRDDVERRKALDAGYNLDRILTTEDLVSGENVFFCATGVTDGDLLKGVRYYAGGCTTQSIVMRSKSGTVRMIEAYHRLSKLNEYSAIDFTGDNNAAYPLP

SEQ ID NO: 24516 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 24517 - protein, 483 aa, Sorghum bicolor
MSSSGQYSSPRRAATATLLLALAAGSFLLLPALARGSSSSSSFEEDRISALPGQPNDGVAFDMYGGYVTVDEHAGRAFYYWLQEADRGEVEDPDTAPLLLWLNGRPGCSSVGYGAMEELGAFRVHTDGHRLLLNEYAWNKVANVLFLDAPAGAGFSYSNTSSDLLVAGDISTAHDSYTFLVKWFERFPQYKYRDFYIAGESYGGHYVPQLSQLVYRNNIGVEKPVINLKGFMVGNGLTDDRADMVGMFEFWWHHGLIADETLDTGLKVCPGSSFIHVTPECRKIWDKALEEQGHIDGYSIYTPPCDKGSPYAHRLQSRPHPLMMLPAYDPCTAFYSTKYLNLPEVQTAMHANVSGSMEYPWVVCSNLLFDNWTDAATSMLPIYRELIEGGLKVWVFSGDTDTVVPLSATRRSLAALSLPVKTSWYPWMIVGCYEHELASDMAKSRALGKDILCRGPPAETLGKEKPSAKTPSAILFLNRRSMS

SEQ ID NO: 24518 - protein, 657 aa, Sorghum bicolor
MHEGLAVVELAVGTHRPVRARTHEFVSPAHKFATRPGEEAVVDEGLKGMGIFEALGGICSGATAEEQELAADSMAGHDEGRGNTDSEGGYRGRGGKQMATLEEYEEARNLRMGDRPRSTFRVHMGEDKVCRKDWCWSVRADYILEKLPDVSGPSFVQFHGRVCRSCAGIVHMSGVDLKWSYNMALDTRTWPREDVPGLGLTDEDVSLLWRTSRRQPPPGTGVGARVLEEQDHQQREDDLIRGLPGLPPNDDVPFDMYGGYITVDEQAGRALYYWFQEADRTEVEDPDAAPLLLWLNGGPGCSSIGGGALEELGAFRVHTDGERLLRNEFAWNRAHDAYKFLVKWFERFPKYKYRDFYIAGESYGGHYVPQLSQLVYRNNIGVENPSINFKGFMVGNGLTNDRTDMIGMFEFWWHHGLISDETLESGLKICPGSSFIHIEPECQKIWDKAVEEQGNIDGYSIYTPPCDKGTPYARRRLRRSRRPLMLPAYDPCTAFYSTKYLNLPEVQTAMHANVSGIIDYPWVLCSDPLYYNWTDTPASMLPIYKELIGAGLKVWVFSGDTDTAVPLSGTRRSLAALGLPVKTSWYPWYIVSTETRVLLSSPIRSSCPPMVMTAESYAEPVVMIMVFTTGSDGHYFHLPSNQRWNFFLPPVWFYNSN

SEQ ID NO: 24519 - protein, 362 aa, Sorghum bicolor
MHTVSRGEQEKNAISRSPGEYYSPWRAATTTLLLALAAVVSLLLPALAQGSSEDDRILAMPGQPNDVAFDMYGGYITVDEQAGRALFYWFQEADQTAVKDPDDAAPLVLWLNGGPGCSSIGGGALEELGAFRVHKDGERLLLNEYAWNKAHDAYTFLVKWFERFPKYKYRDFYIAGESYGGHYVPQLSQLVYRRNIGVDKPIINFKGFMVGNGLTDDRTDMIGMFEYWWHHGLISDETLARGLKVCPGTSLIHASPECKEVWDVATKEQGNIDGYSIYTPPCEKGNPYARIFERSRRQVGGWSMEYEGLTFVTVRGAGHEVPLHRPEQALFLFKQFLQGEPMPAEAKNASLIQLPSEKAHSY

SEQ ID NO: 24520 - protein, 319 aa, Xerophyta viscosa
MAHAPCFADAKTQSFKLLSGHSIPAVGLGTWKSGDKAGNAVYTAITEGGYRHIDTAAQYGVHEEVGNALQSALKAGINRKALFVTSKVWCEDLSPERVRPALKNTLEELQLDYLDLYLIHWPIHLKKGAHMPPEAGEVLEFDIGGVWREMEKLVKVGLVRDIGISNFTVKKLEKLLNFAEIKPSVCQMEMHPGWRKHKMFEICRKYGIHTTAYSPLGSSERDLLSDPTVLKIANKLNKSPGQLLVRWAVQRGTSVIPKSTNPERIKENIQVFGWEIPAEDFQILSSLSEQKRVLDGEDLFVNKTHGPFRSAAELWDGEV

SEQ ID NO: 24521 - protein, 210 aa, Drosophila melanogaster
MKLPALHLLFLGYICLARSQDNDENVRRIMKEMEVIPEILDEPPRELLRIKYDNTIDIEEGKTYTPTELKFQPRLDWNADPESFYTVLMICPDAPNRENPMYRSRLHWLVVNVPGLDIMKGQPISEYFGPLPPKDSGIQRYLILVYQQSDKLDFDEKKMELSNADGHSNFDVMKFTQKYEMGSPVAGNIFQSRWDEYVPELMKTLYGVSE

SEQ ID NO: 24522 - protein, 884 aa, Rhodospirillum centenum
MPDRTTDDFGPFTEQIRGTIDGMGTAEFDALPVGAIQVDGSGVIHRYNRTESRLSGRIPERVIGRNFFTEVAPCTNIPAFSGRFMDGVTSGTLDARFDFVFDFQMAPVRVQIRMQNAGVPDRYWIFVRKLEDLRPPGPAPEAPAAHTASVTGEVVDFSVCEQEDIRRVGAIQPWGAVLAVDPRDWTVCAASDNAQALLDCARPPLGRPLGEVLDAGPLAALRDWLPDRTSRSWRGEMARGRRIDIRAHRSGGCVVLDLEPLTARPGEAPVCSLLAAVEADVAVIRQASSLTGLAQACARSVRVLTGFERAIVYRFDADWHGEVIAEDKVEDWPQSFAGLHFPASDIPRQARELYSQSLSRHVPDRDYVPVPVHRIEGTEPLDLSFSRHRSLSPVHLQYLRNMGVTASMSFSILVEGRLWGMVAAHHRQPHHVAIPRRSAAMTVVEAVALSIAAVERAEAMRGRQVDHAVLTALMVQMASSDAVEPALTQQATRLTDLFGATGAALSIDGHLLTVGDWPPPAEVAALRAWLEPRWGSAGLFRTSSLSSVFPDATAYRQKASGCLALRLSGGDFVMWTRPEEPRQITWGGDPAKALGAAGQRPMPRISFDRWVEERRGHAAPWPTWADEIATSLRHAISDMMLRHLRHVKELSDQLAASNEAKSRFLANMSHELRTPLNAIIGFSDLMMSGMAGTLPPRIQDYVQSIHASGEHLLRMVVNDVLDLSRIEAGRMELSPESLDAGILAAECVGMLLPRAVRGEVLLEVQAESPLPLTADALRLRQILLNIIGNAVKFTPPGGRVDVRARALAGGGAVFTVRDTGPGMTPEEVLTAMEPFRQVAQTRAAVEGTGLGLPIAKSLVDLHAGNLAIETAPGLGTTVTIEIGA

SEQ ID NO: 24523 - protein, 438 aa, Pinus radiata
MVLENFGGVGAREASCRIRHELRGIGGWRMSMPKLCDVCQVSSSVIYCRAHTAQLCLVCDAKIHGGSKASLCHERVWVCEVCEQAPAVVTCKADAAALCVACDTDIHSANPLASRHERAPVIPFYECPNMPTNNTVTHANNDNLDCNVLLNEDGGGDDPLKHDYVDDDYGDYDDDENDQNNLLNNQEDNNDAEICCAEEAATASWLIPEANRNNLTIINGGNSEGEDKMVKDKLKFKAYMQSMDFLQDVDNYADLEYLGTTTITTPINPTANMGADSMVPVHTPEVIEHSSTKVSIDTAGSMDVDAASKCNHVYRTTSLNHCVSSSPIDVGIVPDSNITSDISTPYHDPRGVFEIPPRVVHPGGQGEVMGREARVLRYREKRKNRRFEKTIRYASRKAYAETRPRIKGRFAKRTEVEVEQIYSSSLLPDQGYGVVPSY

SEQ ID NO: 24524 - protein, 403 aa, Pseudomonas aeruginosa
MNNSFWKAGHAPTLFAAFLYFDLSLMVWYVLGPLGVQIAGDLQLSTQQRAMMVATPILAGAVLRFLLGLLADRWSPKSSGILAQVIVIAALAAAWLLGVNSYEQALLLGLFLGFAGASFAVALPLASQWYPPQHQGKAMGIAGAGNSGTVLAALFAPGLAAAFGWNNVFGFALLPLVLTLLVFAMVARNAPQRPAPKAMGDYLKAFGDRDSWWFMFFYSVTFGGFLGLASTLPGYFHDQYGLNPVTAGYYTAACVFAGSLMRPLGGALADRIGGIRSLLMVYTLAAICIAAVGFHLSSAMAALGLFVVAMLSLGAGNGAVFQLVPQRFHKEIGVMTGLIGMAGGIGGFCLTAGLGAIKQSTGDYQLGLWLFASLGVLAWFGLHGVKRRWRTTWGSAAVTAARV

SEQ ID NO: 24525 - protein, 305 aa, Homo sapiens
MDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 24526 - protein, 454 aa, Homo sapiens
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 24527 - protein, 942 aa, Homo sapiens
MAAAAEPGARAWLGGGSPRPGSPACSPVLGSGGRARPGPGPGPGRDRAGGVRARARAAPGHSFRKVTLTKPTFCHLCSDFIWGLAGFLCDVCNFMSHEKCLKHVRIPCTSVAPSLVRVPVAHCFGPRGLHKRKFCAVCRKVLEAPALHCEVCELHLHPDCVPFACSDCRQCHQDGHQDHDTHHHHWREGNLPSGARCEVCRKTCGSSDVLAGVRCEWCGVQAHSLCSAALAPECGFGRLRSLVLPPACVRLLPGGFSKTQSFRIVEAAEPGEGGDGADGSAAVGPGRETQATPESGKQTLKIFDGDDAVRRSQFRLVTVSRLAGAEEVLEAALRAHHIPEDPGHLELCRLPPSSQACDAWAGGKAGSAVISEEGRSPGSGEATPEAWVIRALPRAQEVLKIYPGWLKVGVAYVSVRVTPKSTARSVVLEVLPLLGRQAESPESFQLVEVAMGCRHVQRTMLMDEQPLLDRLQDIRQMSVRQVSQTRFYVAESRDVAPHVSLFVGGLPPGLSPEEYSSLLHEAGATKATVVSVSHIYSSQGAVVLDVACFAEAERLYMLLKDMAVRGRLLTALVLPDLLHAKLPPDSCPLLVFVNPKSGGLKGRDLLCSFRKLLNPHQVFDLTNGGPLPGLHLFSQVPCFRVLVCGGDGTVGWVLGALEETRYRLACPEPSVAILPLGTGNDLGRVLRWGAGYSGEDPFSVLLSVDEADAVLMDRWTILLDAHEAGSAENDTADAEPPKIVQMSNYCGIGIDAELSLDFHQAREEEPGKFTSRLHNKGVYVRVGLQKISHSRSLHKQIRLQVERQEVELPSIEGLIFINIPSWGSGADLWGSDSDTRFEKPRMDDGLLEVVGVTGVVHMGQVQGGLRSGIRIAQGSYFRVTLLKATPVQVDGEPWVQAPGHMIISAAGPKVHMLRKAKQKPRRAGTTRDARADRAPAPESDPR

SEQ ID NO: 24528 - protein, 977 aa, Homo sapiens
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDEGDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVVSEGSHPFGKSLQRQANILLGACSLDCLHPEKHEDVIARELIEKMIAMDPQKRPSANDVLKHPFFWSLEKQLQFFQDVSDRIEKESLDGPIVKQLERGGRAVVKMDWRENITDPLQTDLRKFRTYKGGSVRDLLRAMRNKKHHYRELPAEVRETLGTLPDDFVCYFTSRFPHLLAHTYRAMELCSHERLFQPYYFHEPPEPQPPVTPDAL

SEQ ID NO: 24529 - protein, 463 aa, Homo sapiens
MVQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPSTYSLSQRQIWALALTGPGAPSSLTSQKTLHPLRGPGFLPPVMAGAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 24530 - protein, 1265 aa, Homo sapiens
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLYIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 24531 - protein, 411 aa, Homo sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGVVMWYLYPIKNLEMSQQ

SEQ ID NO: 24532 - protein, 524 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 24533 - protein, 381 aa, Mus musculus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSAQMQQ

SEQ ID NO: 24534 - protein, 423 aa, Mus musculus
  unsure (1)..(423): unsure at all Xaa locations
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYXRAXEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSDAAVSSKATPSQSSSINDISSMSTEHTLASDTDSSLDASTGPLEGCR

SEQ ID NO: 24535 - protein, 1194 aa, Sporothrix schenckii
MAEEQQMQQILKKIDIEKVFLGKAIEMRKAANSDNADVLSKLDSAVHSARRHLEYYEDMLRQVQVRRLGQGVDNMSLGSGGSNSPAPGSLRPRSTDLRNEAGGAPPTPPPKDSASSWGDTSTLNSQNYAASTYSQHGVQSPSNYSDSPADTAVVKTRPNYTKLDLIKYDTPYMGPRIQHMLSQIQFKLDVEEQYLKGIEKMVQLYQMEGDKKSKADAASKKVESKQKIVLLKQALKRYEELHIDVDSGDTPDDDSVNVPNMRKPLSGNLSIRIMAVKDVDHAPTGRFSRGPDTFVAVKVEDNVAARTRLSRTDRWESEFHSVDVDKANEIELTVYDKPGEYAIPIGMLWVRISDIAEEIRRKRIEAEINSSGWVSADKMSAAPNRVPPAQFPMNPQGQFGAQQNAQGGPLSPQNPHGGGFDGVGAHAAHLSPEPITGWFNLEPTGQIQLNLNFVRQNKDRRPLDLGLGRKGAIRQKKEEVHEMYGHKFVQRQFYNIMRCALCGDFLKGGAGMQCEDCKYTCHIKCYSSVVTKCISKSNAETDPDEEKINHRIPHRFQPFGNYTANWCCHCGYLLPFGKKSCRKCSECGLTAHSGCAHLVPDFCGMSMAVANQILEGIRTQKQRQKQSTNLGDRTLRPGKPNLISQQGGYGSQSAAPSPYGPGVASTQATEAAKVMYANQPPPQRPQHPDRTASASSSAAAAAAAASMAMSGSGAKAGTGPQAQASQDSWRHDPGNYGDSYDPQSVQQQQQSYGNAPQQRKYNPADYINVGQYPATRQQPGQMQHAQQQPVTIQQQQQQQQQIYQQPQPQPLQQQPPQAPVQVKTQQSEPPVSLPPVSSTAVDVTGPGVKKPLPSATDPGTGQRIGLDNFNFLAVLGKGNFGKVMLAETKRSNRLYAIKVLKKEFIIENDEVESIRSEKRVLLVANRERHPFLTNLHACFQTETRVYFVMEYISGGDLMLHIQRGQFGTRRAQFYASEVCLALKYLHENGVIYRDLKLDNILLTLDGHIKIADYGLCKEDMWYGSTTSTFCGTPEFMAPEILLDKKYGRAVDWWAFGVLIYQMLLQQSPFRGEDEDEIYDAILGDEPLYPIHMPRDSVSILQKLLTRDPDQRLGSGPTDAQEIMSQPFFRNINWDDIYHKRVQPPFLPTIKNPTDTSNFDSEFTSVTPVLTPVQSVLSQAMQEEFRGFSYTADFV

SEQ ID NO: 24536 - protein, 104 aa, Escherichia coli
MLAGHEESGGRIVEENGEKFMLFYGMSSESAMKRHVGGVAEYRAAEGKTVKLPLRGPVENTARDILGGLRSACTYVGASRLKELTKRTTFIRVQEQENRIFNNL

SEQ ID NO: 24537 - protein, 235 aa, Rattus norvegicus
NIFDRKINFDALLKFSHITPSTQQHLKKVYASFALCMFVAAAGAYVHVVTRFIQAGLLSALGALALMICLMATPHSHETEQKRLGLLAVAFLTGVGLGPALELCIAINPSILPTAFMGTAMIFTCFSLSALYARRRSYLFLGGILMSAMSLMFVSSLGNLFFGSIWLFQANLYMGLLVMCGFVLFDTQLIIEKAEHGDKDYIWHCIDLFLDFVTLFRKLMLILAFNEKDKKKEKK

SEQ ID NO: 24538 - protein, 365 aa, Homo sapiens [sequence omitted]

SEQ ID NO: 24539 - protein, 467 aa, Streptomyces aureofaciens
MPTPEAGSASGREAVRFPVVDPATGETFDEAPDQQPGELDDVVARAQRAWHGWRADPAARTAALRGAADAVETAGDDLARLLTREQGKPLAESYAEIARTAARLRYFADLAPRTRRIDDGRPVHSEVRWRPLGPVAAIVPWNFPLQLAAAKFAPALAAGNTVVLKPSPFTPLATRMLGSVLATALPEDVLTVVTGREPLGARLASHPGIRHVTFTGSVPTGRAVAGAAAASLARVTLELGGNDAALLLDDVDVDRIADRLFWAAFRNCGQVCMAVKRVYVPARLHAEVVEALAQRAKTVAVGPGLDPGTRLGPVNNARQLARVEQVTEQALADGARAAWGGHRLDGPGYFFAPTILTDVLPGSPVVTEEQFGPVLPVLPYRSLDEAVDAANSTGFGLGGSVWGTDLDQAETVADRLECGTAWINHHAELSLAQPFAGVKDSGVGVAGGPWGLYGNLRPFVVHRPQEV

SEQ ID NO: 24540 - protein, 317 aa, Rana sylvatica
MTDAANSFAKDFLAGGVAAAISKTAVAPIERVKLLVQVQHASKQITADKQYKGIMDCVVRIPKEQGFISFWRGNLANVIRYFPTQALNFGFKDKYKKIFLDNVDKRTQFWRYFAGNLASGGAAGATSLCFVYPLDFARTRLAADVGKAGAGREFNGLGDCLAKIFKSDGLKGLYQGFNVSVQGIIIYRAAYFGIYDTAKGMLPDPKNTHIFVSWMIAQSVTAVAGFGSYPFDTVRRRMMMQSGRKGAEIMYSGTIDCWKKIARDEGGRAFFRVPGPTCSEAWVVLLSWSCTMSSRKSSKFILVQMSVTWHAVLCNIP

SEQ ID NO: 24541 - protein, 540 aa, Staphylococcus xylosus
MEKNKVMDWTTFIGSSIILLIAVIPMMVFPKASQDIITKMNDAVSSSIGSIYLLIGLATLIFVLYIAFGKYGNVTLGKATDKPEFNNFSWAAMLFCAGIASDILYWGIIEWAFYYQDPPHGGKGMTDSALNYATMYGMFHWGPIAWATFVLPALCIGYLVFVKNKPVYKISQTLRPILKGQTDGIVGKIVDIIFIFGLLGGAATSLALGVPMITAGIERLTGIDGDNMLMKSIILLVITAIFAYSSYSGLKKGIKVLSDGNVILSFILLGFVLVVGPTVFIMETTITSMGNMFKNFFQMATWIEPFGGIGGREETMFPQKWTIFYWAWWIVYAPFIGLFIARISKGRTLKELVLGTLVYGTLGCMLFFGIFGNYAVYLQISGQFNVIEFLNSHTTEATIIEVLHHLPFPNLVIVLFLISAILFLATTFDSGSYILAAASQKKVIGEPLKANRLYWAFALCLLPFALMLVGGERALDVLKTASVLASVPVLIVFVMMMISFLRTLSEDRLKLEHRADKYREVERRSLRITQVREKKEDDNL

SEQ ID NO: 24542 - protein, 497 aa, Staphylococcus xylosus
MELVKNLSRRQFIDGEWVESSNKETRKIINPFNQEVIFEVAEGTADDSERAILAARRAFEDGEWANETSENRGKKVRAISDLIVKHREELAKLETLDTGKTLEESYADMDDIANVFNFFAGLADKDGGEIIDSPIPNTESKVIKEPIGVVTQITPWNYPLLQASWKIAPALASGCSLVMKPSEITPLTTIRVFELMEEVGFPQGVINLVLGKGSEVGEPLSAHKEVDLVSFTGGIQTGKHIMKNAADHVTNIALELGGKNPNIIFDDADFDLAVDQALNGGFFHAGQVCSAGARIIVHNDIKEKFEAALIERIKNIKLGNGFDEDTEMGPVISAEHREKIENYMEVAKSENATIAIGGKRPEREDLQDGFFFEPTVITDCDTSMRIVQEEVFGPVVTIESFTTEAEAIKLANDSIYGLAGGVFTNDVGKAQRIANKLKMGTVWINDFHPYFAQAPWGGYKQSGIGRELGKAGLAEYQEEKHILRNTNPEPVNWFGKA

SEQ ID NO: 24543 - protein, 460 aa, Pseudomonas putida GB-1
MSFTRRQMLKGLTGLVVVGLGAGGAARYWLGKVEDDNAGHDYELIAAPLDVELVPGFKTEAWAFGPSAPGTELRVRQGTWLRVRFINHLPVETTIHWHGIRLPLEMDGVPYVSQLPVKPGEYFDYKFRVPDAGSYWYHPHVSSSEELGRGLVGPLIVEEREPTGFLHERTLSLKNWHVDEQGAWLPFSIPREAARNGTAGRLITINGQADSVTELPAGQVVRVRLLNLDNTWTYRLNLKGNCEAKIYALDGNPVTPRPLEDDYWLGPGMRICLAIRIPQAGEEISLRDGFVRLGTLRSVASNDAPSDWPPALPPNPIAEPDLENAEKLNFNFEWAASVTVTPDPDKPSSMWQINGQAWDITDKTCADRPIATLQKGKSYIFELKNMTQYQHPIHLHGMSFKVIGSNRHDIKEPWFTDTYLLGKNERAQVALVADNPGTWMFHCHVIDHMETGLMAAIAVV

SEQ ID NO: 24544 - protein, 418 aa, Emericella nidulans
MSDLQVQGRKVFKVFNQDFIVDDRYTVTKELGQGAYGIVCAATNVQTGEGVAIKKVTNVFSKKILAKRALREIKLLQHFRGHRNITCLYDMDIPRPDNFNETYLYEELMECDLAAIIRSGQPLTDAHYQSFIYQILCGLKYIHSANVLHRDLKPGNLLVNADCELKICDFGLARGFSIDPEENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 24545 - protein, 546 aa, Avena sativa
MYRVKSESDCEMMHEDQMDSPLADDGGSSGGSPHRGGGPPLKKGPWTSAEDAILVDYVKKHGEGNWNAVQKNTGLFRCGKSCRLRWANHLRPNLKKGAFTPEEERLIIQLHSKMGNKWARMAANLPGRTDNEIKNYWNTRIKRCQRAGLTIYPASIINQSANEDQQGSSDFNCGENLSNNLLNGNGLYLPDFTCDNFIANSEALSYAPQLSAASISNLLGQSFASKGCGFMDQAGMLKQSDSLLPGLSDTINGALSSVDQFSNDSEKLKQALGFDYLHEANSSSRIIAPFGGALTGSHAYLNGTFSASRSTNGPLKMELPSLQDTESDPNSWLKYTVAPTMQPTELVDPYLHSPAPTPSVKSECASPRNSGLLEELIHEAEALRSGKNQQPSVRSSSSSVSTPCDTTVVSPEFDLCQEYWEEHPSTMLVQEYAPFSGTESTAPASAASPDVFQLSKISPAESHSLGSGEQVMEPSYEPGAGDTPPHPENLRPDAFFSGNTSDSSLFNNAIAMLLGNDLNTECKPVLFDPSSWSNMPHACQMSEEFK

SEQ ID NO: 24546 - protein, 110 aa, Lilium longiflorum
MISSANNKGAGTSRRKLRSEKAALQFSVSRVEYSLKKGRYCRRLGATAPVYLAAVLENLVAEVLDMAANVTEETSPIVIKPRHIMLAPRNDVEVEQAVSRCHHLGIRCRP

SEQ ID NO: 24547 - protein, 331 aa, Zea mays
GNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 24548 - protein, 609 aa, Spermatozopsis similis
APAHAPPPLPSPQVLAQQAARALSMAPPPPPSALQQAASQPAPPAYAPPPQPASYAPQPAQQQAPAPPTYAPPPAQQQAPQAPAYAPPAPAQQQAPAPQAPQAYAPAPVAPAPQAPPPQQPPQQQQWAPAPAAPPGAALLQSAGALAGPAPSAGQVAAAQAVLSRQAAPAAAPQAPQAPQFAPPPQAPQFAPAPQQPQPQQQQPAAPQFAPPPQAPAPQPQFAPAPQQQQALAPQFAPAPQQPQQQPAFAPAPQAPAPQAPAPQFAPQQPLAPQFAPVPQAPAYAPAPQQPSYAPASPPAAGSPQPRPPAGSPVRPPAPTTESVLSADSEEGDGSYSFEFDASEASAASPVRVKGGRSGSIGAAASGSAGAPGSRSAAGRYGDVQQSLEALSPAPRAPAAPAAAAGPPVLRRLPADPAAWAAAGAGDDTLILSVESLTLSADALRDPRLGEGAHVMVSHMLLEAFTAARDQTTAAAPARRGAIGFEYAVGYSLLARDGAPSEAGAALQRQVAVEGECIVPLVLLATTNPQVDLDVTSSGEFDMIGMAEVDLSDWFVNPKREDWVSRDVRLSPHESAAAGYPSGVAGVVRVTLRARGALAALRRACGEGR

SEQ ID NO: 24549 - protein, 130 aa, Bacillus cereus
MSLTSLKDYTTLHNGVKMPWFGLGVFKVEDGSEVIESVKAAIKNGYRSIDTAAIYQNEEGVGQAIRESGVSREELFITSKVWNSDQGYETTLQAFETTLEKLGLEYLDLYLVHWPVKGKYTESWKALEKL

SEQ ID NO: 24550 - protein, 805 aa, Medicago truncatula
MATERLTRVHSLKERLDETLTANRNEILALLSRLEAKGKGILQHHQVIAEFEEIPEDSRQKLTDGAFGEVLRSTQEAIVLPPWVALAVRPRPGIWEYLRVNVHALVVENLQPAEFLKFKEELVDGSANGNFVLELDFEPFTASFPRPTLNKSIGNGVQFLNRHLSAKLFHDKESLHPLLEFLRLHSYKGKTLMLNDRIQNPDSLQHVLRKAEEYLSTIDPETPYSEFEHRFQEIGLERGWGDTAERVLESIQLLLDLLEAPDPCTLETFLDRIPMVFNVVILSPHGYFAQDDVLGYPDTGGQVVYILDQVRALESEMLSRIKKQGLDIIPRILIITRLLPDAVGTTCGQRLEKVYGTEHCHILRVPFRDTKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDKVGQYESHTAFTLPGLYRVVHGIDVFDPKFNIVSPGADQTIYFPYTETSRRLTSFYPEIEELLYSSVENEEHICVLKDRNKPIIFTMARLDRVKNITGLVEWYGKNAKLRELVNLVVVAGDRRKESKDLEEIAEMKKMYGLIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKVDPSHWDKISQGGLQRIEEKYTWTIYSQRLLTLTGVYGFWKHVSNLDRLESRRYLEMFYALKYRKLAESVPLAVE

SEQ ID NO: 24551 - protein, 805 aa, Medicago truncatula
MATERLTRVHSLKERLDETLTANRNEILALLSRLEAKGKGILQHHQVIAEFEEIPEDSRQKLTDGAFGEVLRSTQEAIVLPPWVALAVRPRPGIWEYLRVNVHALVVENLQPAEFLKFKEELVDGSANGNFVLELDFEPFTASFPRPTLNKSIGNGVQFLNRHLSAKLFHDKESLHPLLEFLRLHSYKVKTLMLNDRIQNPDSLQHVLRKAEEYLSTIDPETPYSEFEHRFQEIGLERGWGDTAERVLESIQLLLDLLEAPDPCTLETFLDRIPMVFNVVILSPHGYFAQDDVLGYPDTGGQVVYILDQVRALESEMLSRIKKQGLDIIPRILIITRLLPDAVGTTCGQRLEKVYGTEHCHILRVPFRDTKGIVRKWISRFEVWPYLETYTEDVAHELAKELQGKPDLIVGNYSDGNIVASLLAHKLGVTQCTIAHALEKTKYPESDIYWKKFEEKYHFSCQFTADLFAMNHTDFIITSTFQEIAGSKDKVGQYESHTAFTLPGLYRVVHGIDVFDPKFNIVSPGADQTIYFPYTETSRRLTSFYPEIEELLYSSVENEEHICVLKDRNKPIIFTMARLDRVKNITGLVEWYGKNAKLRELVNLVVVAGDRRKESKDLEEIAEMKKMYGLIETYKLNGQFRWISSQMNRVRNGELYRVICDTKGAFVQPAVYEAFGLTVVEAMATGLPTFATLNGGPAEIIVHGKSGFHIDPYHGDRAADLLVEFFEKVKVDPSHWDKISQGGLQRIEEKYTWTIYSQRLLTLTGVYGFWKHVSNLDRLESRRYLEMFYALKYRKLAESVPLAVE

SEQ ID NO: 24552 - protein, 408 aa, Solanum tuberosum
MAASAATATATTSYLSALDKKTPFLFALDKKTPFLCPKSSTKRRSFNGGVKCMAIETTSGFTATKKRSGYELQTLTSWLLRQEQAGVIDAELTIVISSISMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYNPNDECLADHGDDSTLDNIEQKCIVNVCQPGTNLLAAGYCMYSSSVIFVLTLGNGVFSFNLDPMYGEFVLTQENVQIPKSGKIYSFNEGNYQLWDDKLKKYIDDLKDPGPSGKPYSARYIGSLVGDFHRTLLYGGIYGYPRDQKSKNGKLRLLYECAPMSFIVEQAGGKGSDGHQRVLDIQPTEVHQRVPLYIGSTEEVEKLEKYLS

SEQ ID NO: 24553 - protein, 498 aa, Alcaligenes faecalis
MGSAKSVKKLSSGRLMMSSRCRPTCGPAIRPRAAQHAFSRFQPARFTVAWAFSQKRLGSEPMHTEHAYALPECRNLFYGGRFHVPQGGYGRTLNPATQEDLGPVSNANAADVDAAVQAAHLAFQSWRHTKPAVRAAALREFGNRLRTHAEELGFLDAINCGNPVREMAADVHFAATQVDYFAGLVHEAKGDTLPMGDGVLNYSVREPYGVVARIVAYNHPLMFLAAKLAPAVAAGNTVILKAATQAPLSAYRLATLLQDVFPPGVVNVLSGDTPCGQALVDHPLVKKVSLIGSTATGKSILRSAAEKVMPVSLELGGKNPLIICPEADMDKAIEGAVKGMNFTWAGQSCGSTSRCFVHRSVYDRVIKEMVQKISQLYRCGLPTDPATTMGCLVSKAQYEKVMSFIDSAHKEGARLVCGGVRPSDKALDNGWFVTATVFADVTPAMRLFREEVFGPVLAVIPWDEEEESAAHGQWAGFRLDRFNMDKGSGPRPSPGISR

SEQ ID NO: 24554 - protein, 511 aa, Alcaligenes faecalis
MGEEMKTESKKPDSARSELAMKYFQAEYGHFINGEWVGGSSSEKIAMINPANLEVLSYIQSGNAEDVNRAVEAATQAFPKWSRSTPSERQAALYEMARRLRARANDYAAMLSLDNGKPIMEALHIDIPATIGQFELFAGAAFGLHGQTIDATQGVAIIHREPLGVVAQIIPWNVPLVMMATKIAPALAAGNTIVLKPAESVCLAVMEFIREMADLLPPGVLNVITGYGPNVGEALVTHPNVRKVAFTGSRPTAQKLMQYASVNVIPQTLELGGKSANIICADADMDAAAESAAMSIVVNKGEICFAATRHFVHESVMDAFVEKVQNILRKIRVGDPMIPSTQMGPQASRMQFDKVLGYLDIGRNEGATTAMGGKRATVSGFEQGYFIEPTLFTDVRNKMRIAQEEIFGPVGVVIPWKDEAQVIREANDTEFGLAAGLWTKNITQAHRMAREIEAGTVWVNRYFNMIPNVPFGGYKQSGFGREFSLDVLSHYTQLKSVIVSLQEGPIGLFDH

SEQ ID NO: 24555 - protein, 878 aa, Microbispora rosea
MPKYVYDFTEGNKDLKDLLGGKGANLAEMTNIGLPVPPGFTITTEACRHYLQHGGMPDGLAEEIDEHLAALEERMGKRLGQADDPLLVSVRSGAKFSMPGMMETVLNIGLNDDSVVGLAKQSGNDRFAWDSYRRLIQMFGKTVLGIDGELFENAMDELKGERDDTDLEAADLQRLVDTFKRIVRDQTGRDFPADPREQMDLAVRAVFDSWNAPRAILYRRQERIPADLGTAVNVVAMVFGNMGPDSGTGVAFTRDPGSGRQGVYGDYLRNAQGEDVVAGIRNTIPLQELESINPQAYRELLDIMATLERHYRDLCDIEFTIERGKLWMLQTRVGKRTAEAAFRIATQLVDEGLIDMDEAVARVTGDQLAQLMFPRFAATADARRLTTGMNASPGAAVGKAVFSSERAVELAGQGEAVILVRRETNPDDLAGMIAARGVLTSRGGKTSHAAVVARGMGKTCVCGAEELEVDPHARRFTAPGGIVVNEGEVISIDGSTGAVYLGEVPVTASPVARYFEGEPAEDELVRAVDRIMTHADSVRRLAVRANADTPEDAARARRYGAQGIGLCRTEHMFLGERRRLVEDLILAATPEERQAALDALEPLQTEDFTGIFTAMRGLPVTIRLIDPPLHEFLPDLTELAVKVAVAGEAADDRDRRLLEAVKRLHEQNPMLGLRGVRLGLTIPGLFAMQVRAIAAAARRVEDARAEIMIPLVGAVQELEIVREEAERILAEAGVTAAIGTMIEVPRAALTAGQIAEAAEFFSFGTNDLTQMTWGFSRDDVESAFFGQYLDLGVFGVSPFESIDREGVGRLMRIAVEEGRRARPGLKLGICGEHGGDPDSVRFCHEIGLDYVSCSPFRIPVARLEAGRAALTCAASDTR

SEQ ID NO: 24556 - protein, 886 aa, Candida albicans
MEFSNKRSRDDFEQDEGQFHDGPSHDSFDHKRHHIDPAQELINNICKDIRRLGEAGDIENLIADTNYISNPIVAEFEKIDNLRNSILSTIYALITEQPHKISAIANLILICNAKNFVIAKYVIEYLHSKMQTMLDSQEGSVFNDIKNILKFLSTLTPIIEDNGIIQIFKQFLNFAIELQEQTEVRNGLAQEIYYNVLIAIPYVLSNDNSDDLKKSINELIELARNFKIVAESATVLLPFDTRMGNFELPYIPKQMVDLILPALIKLQNDDWNFRLFLDFKTHLDPVIQSALENNSISSELVKHKLPQLSFPSVENASFKSTSIDKLWNDNPRYLFQVYNNTTEYETVPPIETYLGLFFKDIAFDILTNLSFNKNETAIELSILDMFFDNKLFAPPGTSIDQLNAIYEDNKSGTNDPSLSTWKIEDVAVESILTMIFQLPNPLEVEIYYYTVLISCCRESPESIAPVFGRAIRYFYNHLETLDYELKIRFLDWMSIQLSNFEFSWKWEEWVSDSKKLKDLKYHPKKNFIKNLIAKEIRLSNKKRIKDSFIDIVDGEVVNLDEFYQYLDISMVPDVKSYIISYDTELYGESSRDTLIQLYEQKQEQLNSKSNIGAQNEIFFNFTNSELPFHETASKVYDFILTHWKSNTDFNELYKSVLESITAPNNERFAINLIIQTYAYIGSRSIYSVVSILSRDINKLKFLSGAPIDYVGDEARFEDLHFTEEEKQNRQNWIIEAVFRIWIHQPQVVFLILEYLIEFGIIDPKYILVKALESNLIIDNVSCMESINRILSKAESKELIIQLFTAIIDNLNKLELDKEKRVEIEEVTESNATEVDKQWLFYEYLGLLKSYYRKYIIGDVECHDKVKEIVGQLENASAKDEILKWFG

SEQ ID NO: 24557 - protein, 314 aa, Pyrus pyrifolia
MATFPVVDLSLVNGEERVATLEKINDACENWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSIASFYNPGDDAFISPAPAVLEKKTEDAPTYPKFVFDDYMKLYSGLKFQAKEPRFEAMKAKESTPVATT

SEQ ID NO: 24558 - protein, 154 aa, Cicer arietinum
IAPTTRHYRSVSMDSFIGKLNFNDESSKLPPSPGLMSPGNSVDGNSAAAFSLEFGNGEFSGPELKKIMANEKLAEIAMADPKRAKRILANRQSAARSKERKMRYISELEHKVQTLQTEATTLSAQLTLLQRDSVGLTNQNSELKFRLQSMEQQA

SEQ ID NO: 24559 - protein, 78 aa, Cicer arietinum
STHIEPLGLGQGLSMGVLNLAIVVPQIVVSLGSGPWDQIFGGGNSPAFAVAAVAALMSGLLALLAIPRTGTQKPRSRV

SEQ ID NO: 24560 - protein, 576 aa, Mycobacterium leprae
MEQSRRVPPLQWLSAVARPIARVLTLISTPTFDIADTFGYACPNPPEVSPTEGVYVVATKTSPATGQPVKRTATKTPATPAKRSTTKAANGSAPTKRATSTASRATKSTTPPKASGASDAAKKARTSVKSVDTKAPSAQDHTTKASAAKDTLNDPEATLNTLDSDATADDLDAEPDLDVEPSEDIDIDIDIEAADLGLDDLEDDDVVTDIEPGETEDGEATAATKTDEASTDDDEEIVEPTEKDKASGDFVWDEDESEALRQARKDAELTASADSVRAYLKQIGKVALLNAEEEVELAKRIEAGLYATQLMTELSERGTKLPTAQRRDMMWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLETLSEREAGVVRLRFGLTDGQPRTLDEIGQVYGVTRERIRQIESKTMSKLRHPSRSQVLRDYLD

SEQ ID NO: 24561 - protein, 336 aa, Euglena gracilis
MAQTIPDQTALPDTTNWQLSDLTLKETLGTGTFGRVRLCLHKSSGNYYAIKCLKKSEVLRMKQVEHILAEASILGSIRHPFIVNMLKTFQDDKRLYIVLEYVVGGELFSHLRKAGKFPNDVAKFYAAEVILAFEYIHSMDILYRDLKPENLLLDVGGHIKITDFGFAKKVPERTFTLCGTPEYLAPEIIQSKGHGKAVDWWALGILTYEMLVGYPPFFDESPFRIYEKILEGKVQFPKWVDGRAKDLIKGLLTTDHTKRLGTLKRGVTDIKKHKWFYGVDWDMLLARKIPAPIPVKVTTPGDSRYFDRYPESKEDKSQPLTPAQQELFKGFGPYST

SEQ ID NO: 24562 - protein, 272 aa, Deinococcus radiodurans
FSRVHPHRYLDVGIAEEVAVTTAAGMALQGMRPVVAIYSTFLQRAYDQVLHDVAIEHLNVTFCIDRAGIVGADGATHNGVFDLSFLRSIPGVRIGLPKDAAELRGMLKYAQTHGRPFAIRYPRGNTAQVPAGTWPDLKWGEWERLKGGDDVVILAGGKALDYALKAAEDLPGVGVVNARFVKPLDEEMLREVGGRARALITVEDNTVVGGFGGAVLEALNSMNLHPTVRVLGIPDEFQEHATAESVHARAGIDAPAIRTVLAELGVDVPIEV

SEQ ID NO: 24563 - protein, 225 aa, Nicotiana tabacum
MRRGRAAAAPAPVTGEPNGSGGSKEIRFRGVRKRPWGRFAAEIRDPWKKTRVWLGTFDSAEDAARAYDAAARALRGPKAKTNFPLPYAHHHQFNQGHNPNNDPFVDSRFYPQDNPIISQRPTSSSMSSTVESFSGPRPPPAPRQQTTASSRKYTRSPPVVPDDCHSDCDSSSSVVDHGDCEKENDNDNDNIASSSFRKPLLFDLNLPPPMDDAGADDLHCTALCL

SEQ ID NO: 24564 - protein, 398 aa, Arabidopsis thaliana
MKPSSPISLTSSSIARKARFSPYLFTLLAFILFVSVLYGEDFMCIFGQLEPNFVLPPSRTPEESCDVFSGKWVRDEVSRPLYEEWECPYIQPQLTCQEHGRPDKDYQFWRFNASLMLETLRGKRMMYVGDSLNRGMFVSMICLLHRLIPEDQKSIKTNGSLTVFTAKEYNATIEFYWAPFLLESNSDDAIVHRISDRVVRKGSINKHGRHWKGVDIIIFNTYLWWMTGLKMNILEVSDIGGIYRQGSFDDKEKNIVEVSTEDAYRMGMKSMLRWVKNNMDRKKTRVFFTSMSPTHAKGIDWGGEPGQNCYNQTTLIEDPSYWGSDCRKSIMKVIGEVFGRSKTPITKDAHTSIYKKQWSPLTAEQLENPTSYADCVHWCLPGLQDTWNELLFAKLFYT

SEQ ID NO: 24565 - protein, 527 aa, Homo sapiens
EAPGSSVKPVLCLHSAARAGKWSLGSGAEQQRLSPGPPVPSLTCLPSARMATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 24566 - protein, 571 aa, Buchnera aphidicola (Acyrthosiphon pisum)
MISGILASPGIAFGTALLLKEDEIVINRKIINIKNITKEIERFFEGRRKSIHQLTEIKTKPKEKFGEKKESIFEGHIMLLEDEELEQEVISLIKEKNMSAAAATELIIEGQAKALEKLKDEYLKNRAIDVRDIGNRLLKNILNLNIIDLNNINNEVILIAKDLTPSETAQINLKYILGFITDLGSRTSHTSIMARSLEIPAIVGTGNITKIVKNNDFIILDSINNQILINPSHKLINQTEVIKKKYLTKKNQLINLKNLQAITTDGHAIKIGSNIGNVEDIKSAKKNGAECIGLYRTEFLFMGRNCLPDENEQFQAYKTIAELMKNKSVIIRTMDIGGDKDLPYMNLPKEENPFLGWRAIRISMDRKEILHTQLNAILRASAFGKIYILFPMIISVEEIRILKSEVRKLQIQLKNNNIPFDKNIKIGIMIETPASAIIAEYLIKEVDFFSIGTNDLTQYTLAVDRGNDLISHLYNPMNPSVLKLIQQVINVSHTHGKWTGMCGELAGDERATILLLGMGLDEFSMSSISIPKIKEIIRKTSFSSAKKLAQKALTLPTNKEILNLVENFVNH

SEQ ID NO: 24567 - protein, 326 aa, Lycopersicon esculentum
MAQESLVLRGTMKAHTDWVTAIATPIDNSDMIVTSSRDKSIIVWSLTKDGAQYGVPRRRLTGHGHFVQDVVLSSDGMFALSGSWDGELRLWDLQAGTTARRFVGHTKDVLSVAFSVDNRQIVSASRDKSIKLWNTLGECKYTIQDGHSHSDWVSCVRFSPNTLQPTIVSGSWDRTVKIWNLTNCKLRSTLAGHSGYVNTVAVSPDGSLCASGGKDGVILLWDLAEGKKLYSLDAGSIIHTLCFSPNRYWLCAATESSIKIWDLESKSIVVDLKVDLKHESEMANESGTAPKTKVIYCTSLSWSADGSTLFSGYTDGLIRVWGIGRY

SEQ ID NO: 24568 - protein, 446 aa, Plasmodium falciparum
MAHVITRINAREILDSRGNPTVEVDLETNLGIFRAAVPSGASTGIYEALELRDNDKSRYLGKGVQKAIKNINEIIAPKLIGMNCTEQKKIDNLMVEELDGSKNEWGWSKSKLGANAILAISMAVCRAGAAANKVSLYKYLAQLAGKKSDQMVLPVPCLNVINGGSHAGNKLSFQEFMIVPVGAPSFKEALRYGAEVYHTLKSEIKKKYGIDATNVGDEGGFAPNILNANEALDLLVTAIKSAGYEGKVKIAMDVAASEFYNSENKTYDLDFKTPNNDKSLVKTGAQLVDLYIDLVKKYPIVSIEDPFDQDDWENYAKLTAAIGKDVQIVGDDLLVTNPTRITKALEKNACNALPLKVNQIGSITEAIEACLLSQKNNWGVMVSHRSGETEDVFIADLVVALRTGQIKTGAPCRSERNAKYNQLLRIEESLGNNAVFAGEKFRLQLN

SEQ ID NO: 24569 - protein, 816 aa, Zea mays
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGYHIDPYQGDKASALLVDFFDKCQAEPSHWSKISQGGLQRIEEKYTWKLYSERLMTLTGVYGFWKYVSNLERRETRRYLEMLYALKYRTMASTVPVAVEGEPSSK

SEQ ID NO: 24570 - protein, 430 aa, Bacillus subtilis
MPYIVDVYAREVLDSRGNPTVEVEVYTETGAFGRALVPSGASTGQYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 24571 - protein, 193 aa, Escherichia coli
MVVFISAALLGSPIRLMAVLGAICGTAGVALLVLTPNAALDPVGVAAGLAGAVSMAFGTVLTRKWQPPVPLLTFTAWQLAAGGLLLVPVALVFDPPIPMPTGTNVLGLAWLGLIGAGLTYFLWFRGISRLEPTVVSLLGFLSPGTAVLLGWLFLDQTLSALQIIGVLLVIGSIWLGQRSNRTPRARIACRKSP

SEQ ID NO: 24572 - protein, 429 aa, Macaca fascicularis
MFLKAVVLTLALVAVTGARAEVSADQVATVMWDYFSQLSSNAKEAVEHLQKSELTQQLNALFQDKLGEVNTYAGDLQKKLVPFATELHERLAKDSEKLKEEIRKELEEVRARLLPHANEVSQKIGENVRELQQRLEPYTDQLRTQVNTQTEQLRRQLTPYAQRMERVLRENADSLQTSLRPHADQLKAKIDQNVEELKERLTPYADEFKVKIDQTVEELRRSLAPYAQDAQEKLNHQLEGLAFQMKKNAEELKARISASAEELRQRLAPLAEDMRGNLRGNTEGLQKSLAELGGHLDRHVEEFRLRVEPYGENFNKALVQQMEQLRQKLGPHAGDVEGHLSFLEKDLRDKVNSFFSTFKEKESQDNTLSLPEPEQQREQQQEQQQEQEQEQQQQQEQQQQQEQQREQQQQEQQQEQQQEQVQMLAPLES

SEQ ID NO: 24573 - protein, 294 aa, Medicago sativa
MEQYEKVEKIGEGTYGVVYKARDRATNETIALKKIRLEQEDEGVPSTAIREISLLKEMQHRNIVRLQDVVHSEKRLYLVFEYLDLDLKKFMDSSPEFAKDQRQIKMFLYQILCGIAYCHSHRVLHRDLKPQNLLIDRSSNAVKLADFGLARAFGIPVRTFTHEVVTLWYRAPEILLGSRHYSTPVDVWSVGCIFAEMINQRPLFPGDSEIDELFKIFRITGTPNEETWPGVTSLPDFKSAFPKWPAKDLATQVPNLEPAGLDLLSSTCRLDPTRRITARGALEHEYFKDIKFVP

SEQ ID NO: 24574 - protein, 292 aa, Dictyostelium discoideum
MEKYSKIEKLGEGTYGIVNKAKNRETGEIVALKRIRLDSEDEGVPCTAIREISLLKELKHPNIVRLHDVIHTERKLTLVFEYLDQDLKKYLDECGGEISKPTIKSFMYQLLKGVAFCHDHRVLHRDLKPQNLLINRKGELKLADFGLARAFGIPVRTYSHEVVTLWYRAPDVLMGSRKYSTPIDIWSALCIFAEMASGRPLFPGSGTSDQLFRIFKILGTPNEESWPSITELPEYKTDFPVHPAHQLSSIVHGLDEKGLNLLSKMLQYDPNQRITAAAALKHPYFDGLEPIN

SEQ ID NO: 24575 - protein, 296 aa, Dictyostelium discoideum
MESDGGLSRYQKLEKLGEGTYGKVYKAKEKATGRMVALKKIRLEDDGVPSTALREISLLKEVPHPNVVSLFDVLHCQNRLYLVFEYLDQDLKKYMDSVPALCPQLIKSYLYQLLKGLAYSHGHRILHRDLKPQNLLIDRQGALKLADFGLARAVSIPVRVYTHEIVTLWYRAPEVLLGSKSYSVPVDMWSVGCIFGEMLNKKPLFSGDCEIDQIFRIFRVLGTPDDSIWPGVTKLPEYVSTFPNWPGQPYNKIFPRCEPLALDLIAKMLQYEPSKRISAKEALLHPYFGDLDTSFF

SEQ ID NO: 24576 - protein, 292 aa, Bos taurus
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRSPDVLFGAKLYSTSIDMWSAGCIFAELANAGRPLFPGNDVDDQLKRIFRLLGTPTEEQWPAMTKLPDYKPYPMYPATTSLVNVVPKLNATGRDLLQNLLKCNPVQRISAEEALQHPYFSDFCPP

SEQ ID NO: 24577 - protein, 473 aa, Antirrhinum majus
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKAPTLTSTLTARSKAASGVKTKTKEQIVDIDAADVNNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASVYAARCTLNKAPFWNETLQLHTGFSEPQLMDCAKLLVAFPKMAGDQKLKSIYRKYSNLERGAVALLSPAKSVFVFLIELLMNAIEKIQCSLFFTSEIWCRF

SEQ ID NO: 24578 - protein, 441 aa, Antirrhinum majus
MGSRHQVVQQQNRGDVVPGAIKQKSMAVEKKNRRALGDIGNVVTVRGVEGKALPQVSRPITRGFCAQLIANAEAAAAENNKNSLAVNAKGADGALPIKRAVARVPVQKKTVKSKPQEIIEISPDTEKKKAPVLEKEITGEKSLKKKAPTLTSTLTARSKAASVVRTKPKEQIVDIDAADVNNDLAVVEYVEDMYKFYKSAENDSRPHDYMDSQPEINEKMRAILIDWLVQVHYKFELSPETLYLTINIVDRYLASKTTSRRELQLLGMSSMLIASKYEEIWAPEVNDLVCISDGSYSNEQVLRMEKKILGALEWYLTVPTPYVFLVRFIKASLPDSDVEKNMVYFLAELGMMNYATIIMYCPSMIAAAAVYAARCTLNKMPIWNETLRMHTGFSEVQLMDCAKLLIDFHGGSTDQKLQGIYRKYSRLEKGAVALLPQPLLA

SEQ ID NO: 24579 - protein, 423 aa, Penicillium janthinellum
FVKNSGICETTPGVNQYSGYLSVGSNMNMWFWFFEARNNPQQAPLAAWFNGGPGCSSMIGLFQENGPCHFVNGDSTPSLNENSWNNYANMIYIDQPIGVGFSYGTDDVTSTVTAAPYVWNLLQAFYAQRPEYESRDFAIFTESYGGHYGPEFASYIEQQNAAIKAGSVTGQNVNIVALGVNNGWIDSTIQEKAYIDFSYNNSYQQIIDSSTRDSLLDAYNNQCLPALQQCSQSGSTSDCTNADSVCYQNIEGPISSSGDFDVYDIREPSNDPYPPKTYSTYLSDPTVVKAIGARTNYQECPNGPYNKFASTGDNPRSFLSTLSSVVQSGINVLVWAGDADWICNWLGNYEVANAVDFPGNAQFSALDLAPYTVNGVEKGQFKTVDNFSFLKVYGAGHEVPYYQPDTALQAFKQIIQKKPISST

SEQ ID NO: 24580 - protein, 428 aa, Zymomonas mobilis [sequence omitted]

SEQ ID NO: 24581 - protein, 355 aa, Kluyveromyces lactis
MAGIKHRRDSAESINTDIITLSRFILDQQHLSAKNATGEFSMLLNSLQFAFKFISQTIRRAELVNLIGLAGASNSTGDQQKKLDVLGDEIFINAMKASGNVKVLVSEEQEDLIVFRNSPGKYAVCCDPIDGSSNLDAGVSVGTIVSLFKIHENQNGNSGEEDSEGTINDVARCGREMVAACYTMYGASTHLVLTTGAGVNGFTLDNNLGEFILTYPELRLPEQKSIYSINEGNTCYWEPTIADFIAKLKENSEENNGKPYSARYIGSMVADVHRTLLYGGLFSYPGDKKNPNGKLRLLYEAFPMAFLVEQAGGKAVNDRGERILDLVPQHIHDKSSIWLGSSGDVDKYLKHIGKL

SEQ ID NO: 24582 - protein, 139 aa, Brassica napus
VIALNLTGVFLCSQAATKIMMKKRKGRIINIASVVGLIGNIGQANYAAAKAGVIGFSKTAAREGASRNINVNVVCPGFIASEMTAKLGEDMEKKILGTIPLGRYGQPEDVAGLVEFLALSPAASYITGQTFTIDGGIAI

SEQ ID NO: 24583 - protein, 345 aa, Dictyostelium discoideum
MRFKCFGSEETEQSSKIDKSIETDRRKLRKDVKLLLLGPGESGKSTIFKQMKIIQEDGGYSVEELLEYRAFVYSNCISQMEALLTASAKLNIELEVENKQRAANVLRRTIGNEPWLLLAADIKHLWEDKGIKETYAQKDKHFQLNDSAAYFFDNIDRYMREDFVPNEQDVLRCRVRTTGIQESEFTFDKIRLKIVDVGGQRSQRRKWIHCFDCVTAVIFVAAMSDYDQVLREDESVNRTRESLALFKEIVNCDYFKETPIVLFLNKKDLFKEKLKRVPLQSCFSDYTGPNKYKDAAMFIQSQYLAQGPSPRTIYTHATCAVDTENIKFVFRAVRQTILSQALEHF

SEQ ID NO: 24584 - protein, 284 aa, Drosophila melanogaster
MQLEKMQIKGKTRNIAAVITYQNIGQDLSLTLDKGYNVTISIIEGRRGVRTISSLNRTSVLFVSISFIVDDILCWLIFYYIQRFRYMQAKDQQSRNLCSVTKKAIMKIPTKTGKFSDEKDLDSDCCAICIEAYKPTDTIRILPCKHEFHKNCIDPWLIEHRTCPMCKLDVLKFYGYVVGDQIYQTPSPQHTAPIASIEEVPVIVVAVPHGPQPLQPLQASNMSSFAPSHYFQSSRSPSSSVQQQLAPLTYQPHPQQAASERGRRNSAPATMPHAITASHQVTDV

SEQ ID NO: 24585 - protein, 138 aa, Tetrahymena thermophila
MSTTGKGGKAKGKTASSKQVSRSARAGLQFPVGRISRFLKHGRYSERVGTGAPVYLAAVLEYLAAEVLELAGNAAKDNKKTRIVPRHILLAIRNDEELNKLMANTTIADGGVLPNINPMLLPSKSKKTESRGQASQDL

SEQ ID NO: 24586 - protein, 133 aa, Tetrahymena thermophila
MSTTGKGGKAKGKTASSKQVSRSARAGLQFPVGRISRFLKNGRYSERIGTGAPVYLAAVLEYLAAEVLELAGNAAKDNKKTRIVPRHILLAIRNDEELNKLMANTTIADGGVLPNINPMLLPSKTKKSTEPEH

SEQ ID NO: 24587 - protein, 129 aa, Gallus gallus
MSGRGKQGGKARAKAKSRSSRAGLQFPVGRVHRLLRKGNYAERVGAGAPVYLAAVLEYLTAEILELAGNPARDNKKTRIIPRHLQLAIRNDEELNKLLGKVTIAQGGVLPNIQAVLLPKKTDSHKAKAK

SEQ ID NO: 24588 - protein, 125 aa, Acropora formosa
MSGRGKGKAQGTKSKSRSSRAGLQFPVGRIHRLLRKGNYAERVGAGAPVYMAAVLEYLSAEILELAGNAARDNKKSRIIPRHLQLAVRNDEELNKLLAGVTIAQGGVLPNIQAVLLPKKTEKKQH

SEQ ID NO: 24589 - protein, 138 aa, Picea abies
MSSSGAKGGRGKAKSTKSVSRSQKAGLQFPVGRIARFLKAGKYAERVGAGAPVYLAAVLEYLAAEVLELAGNAARDNKKNRIVPRHIQLAVRNDEELSKLLGAVTIANGGVLPNIHQVLLPKKSGKDKGEIGSASQEF

SEQ ID NO: 24590 - protein, 103 aa, Acropora formosa
MSGRGKGGKGLGKGGAKRHRKILRDNIQGITKPAIRRLARRGGVKRISGLIYEETRGVLKVFLENVIRDAVTYTEHAKRKTVTAMDVVYALKRQGRTLYGFGG

SEQ ID NO: 24591 - protein, 103 aa, Lycopersicon esculentum
MSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 24592 - protein, 103 aa, Agaricus bisporus
MSGRGKGGKGLGKGGAKRHRKILRDNIQGITKPAIRRLARRGGVKRISGLIYEETRGVLKIFLENVIRDSVTYTEHAKRKTVTALDVVYALKRSGRTLYGFGA

SEQ ID NO: 24593 - protein, 391 aa, Oryctolagus cuniculus
MSGPVPSRVRVYTDVNTHRPREYWDYESHVVEWGNQDDYQLVRKLGRGKYSEVFEAINITNNEKVVVKILKPVKKKKIKREIKILENLRGGPNIITLADIVKDPASRTPALAFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 24594 - protein, 421 aa, Physcomitrella patens
MGRKPCCEKVGLRRGPWTSEEDQKLVSHITNNGLSCWRAIPKLAGLLRCGKSCRLRWTNYLRPDLKRGIFSEAEENLILDLHATLGNRWSRIAAQLPGRTDNEIKNYWNTRLKKRLRSQGLDPNTHLPLEDSKLDDTEDDTDDEGGDSSDVTMSDASKSEKRSKKKSKPKETVKVRQPKGPKPAPQLKMCQSDEGPVLLKVPKAPKSPISVNPGPGCNYDDDSEHSSSSTVTTKSHEDHRDSSDFIKALTSVSSFPEAELWSCIKPITNSFSSTALLSEWDSYRAFDSSLFPSSYPQLNSGLPKLEDVNSKSSAVASPVQGMLPAYNPMGMEMQTRMQFSSQLTHEIGQNYGGIFQETCYPQPDMGMSWSMHAELSHCGTESLFATPNPANAPSNFEEVPQPSPCTTSQELQRLAALLDLI

SEQ ID NO: 24595 - protein, 451 aa, Dictyostelium discoideum
MQPKRMSHNLTVGEKAGSPFNVILNAANNTNSDNSSNNSDNENDDNQNNNNNNNNNNNNNNEEEEEEDDDDDDDSQQNRHNISIPFTINKNSINNNNNLINNINNNINNMNNNMNNNNNNNNMNNNINNNGNSNISNNNTPKVEKKKTKGKWTSEEDQILIKAVNLHNQKNWKKIAEHFPDRTDVQCHHRYQKVLHPNLVKGAWTKDEDDKVIELVKTYGPKKWSDIALHLKGRMGKQCRERWHNHLNPNIKKEAWSDEEDQIIRDQHAIHGNKWAEIAKFLPGRTDNAIKNHWNSSMKRVSNNNVHLKSHAIEHSLSSQDNQDSPKSIITSSSPIPTTTTTTTTTSTTLITPPPPPLLPPPPSINKKEKKFKQPKKRNASEIEQTLSQPHINQHESSPIVFENISNGNNKIDIPAAQYLMTNGISCINNNNNNNNNNNNNNNNNNNNNNN

SEQ ID NO: 24596 - protein, 107 aa, Rhodovulum sulfidophilum
MTVKPPTPTSTPILDRVAGPADLKGMSQADLALLARDLREEVISVVARTGGHLGSSLGVVELTVALHAVFNTPFDKLVWDVSHQCYPHKILTGRRDRMHTLRQGGGL

SEQ ID NO: 24597 - protein, 896 aa, Pseudomonas viridiflava
MAAVLGGYFTWMQLYELQSQLLQRGEMIAQDLAPLSANALGRKDKILLTRIATQTLEQSDVRAVSFLDTDRSVLAHAGPTMISPSPIGSSTQLLNSSGNDATRYLLPVFGHQRHLTSPIIPAEADTLLGWVELEISHNGTLLRGYRSLFASLLLIFTGLAFTAILAVRMSRTINGPLSQIKQAVSQLKDGNLETRLPPLGSRELDELASGINRMAATLQNAQEELQMSIDQATEDVRQNLETIEIQNIELDLARKEALEASRIKSEFLANMSHEIRTPLNGILGFTHLLQKSELTPRQYDYLGTIEKSADNLLSIINEILDFSKIEAGKLVLDNIPFNLRDLLQDTLTILAPAAHAKQLELVSLVYRDTPLALSGDPLRLRQILTNLVSNAIKFTRQGTIVARAMLEDETEEHAQLRISVQDTGIGLSSQDVRALFQAFSQADNSISRQPGGTGLGLVISKRLIEQMGGEIGVDSTPGEGSEFWISLNLPKAREDREETANQALEGLRAAVLEHHDLARQALEHQLEDCGLQTVVFTNLENLLNGVTAAHETPQAIDLVVLGVTALEISPERLRQHIWDLENLNCKVMVLCPTTEHALFQMSVHDVYTQLQAKPACNRKLQKALSELVAPRAVRTDVALPLSSRAPRVLCVDDNPANLLLVQTLLEDMGAEVVAVDGGYAAVSAVQQEAFDLVLMDVQMPGMDGCQATEAIRAWETERNQTSLPIVALTAHAMANEKRSLLQSGMDDYLTKPISERQLAQVVLKWTGLALRNPIPERQTESSNAHVGPLVLDHEEGLRLAAGKPDLAADMLAMLLASLDADREAIRAARANDDIQGLIERVHRLHGATRYCGVPQLRTACQRAETLLKQNAPHTEDALDDLDKAITRLEAEARVTA

SEQ ID NO: 24598 - protein, 335 aa, Sulfolobus acidocaldarius
MIGLAVTTTKKIAKWKVDEVAELTEKLKTHKTIIIANIEGFPADKLHEIRKKLRGKADIKVTKNNLFNIALKNAGYDTKLFESYLTGPNAFIFTDTNPFELQLFLSKFKLKRYALPGDKADEEVVVPAGDTGIAAGPMLSVFGKLKIKTKVQDGKIHILQDTTVAKPGDEIPADIVPILQKLGIMPVYVKLNIKIAYDNGVIIPGDKLSINLDDYTNEIRKAHINAFAVATEIAYPEPKVLEFTATKAMRNALALASEIGYITQETAQAVFTKAVMKAYAVASSISGKVDLGVQIQAQPQVSEQAAEKKEEKKEEEKKGPSEEEIGGGLSSLFGG

SEQ ID NO: 24599 - protein, 253 aa, Bacillus megaterium
MDVEVKKNKNEPYLKDHEVKDLIKRSQQGDQIARDTIVQKNMRLVWSVVQRFINRGYEPDDLFQIGCIGLLKSVDKFDLSYDVKFSTYAVPMIIGEIQRFIRDDGTVKVSRSLKEMSNKIRKAKDELSKLLGRVPTVAEVAEHLDLTPEEVVLAQEANRAPSSIHETVYENDGDPITLLDQIADHTEAKWFDKIALKEAIEELDEREKLIVYLRYYKDQTQSEVAARLGISQVQVSRLEKKILKQMKLHMNDT

SEQ ID NO: 24600 - protein, 485 aa, Catharanthus roseus
MALLVEKTSSGREYKVKDMSQADFGRLEIELAEVEMPGLMSCRAEFGPSQPFKGAKITGSLHMTIQTAVLIETLTALGAEVRWCSCNIFSTQEHAAAAIARDSAAVFAWKGETLQEYWWCTERALDWGPDGGPDLIVDDGGDATLLIHEGVKAEEEYKKNGALPDPSSTDNAEFQIVLTIIRDGLKSDPTKYTRMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQATMEGLQVLTLEDVVSEADIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNERKTGKYEKKVYVLPKHLDEKVAALHLGKLGAKLTKLTKDQADYISVPIEGPYKPAHYRY

SEQ ID NO: 24601 - protein, 633 aa, Phalaenopsis cv. 'True Lady'
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEVLGKGCTTIFIVKVGISEDPAHRYQHKLLPPIRAGQSEADAFGSKRTPTDLIPLKNRYQRSL

SEQ ID NO: 24602 - protein, 131 aa, Cicer arietinum
ERGVGLEHEDENIADLYLAVQDGIISGTTDYDILFGQLLENESGLKGSPPTAKSFVENLPLVELTEEELKGKDIVCAVCKDEVMLEEKVRKLPCSHCYHGDCILPWLSIRNTCPVCRFELPTDDADYERSK

SEQ ID NO: 24603 - protein, 229 aa, Lycopersicon esculentum
MEKVSNSLGSEELTVEERNLLSVAYKNVIGARRASWRIISSVEQKEESRGNEEHVNSIREYRSKIENELSKICDGILKLLDSKLIPSATSGDSKVFYLKMKGDYHRYLAEFKTGAERKEAAESTLTGYKAAQDIASAELAPTHPIRLGLALNFSVFYYEILNSPDRACNLAKQAFDEAIAELDTLGEESYKDSTLIMQLLRDNLTLWTSDMQDDGADEIKEDPKPEEKN

SEQ ID NO: 24604 - protein, 540 aa, Xenopus laevis
MAVTCTRFTDEYQLYEEIGKGAFSVVRRCVKLCTGHEYAAKIINTKKLSARDHQKLEREARICRLLKHPNIVRLHDSISEEGFHYLIFDLVTGGELFEDIVAREYYSEADASHCIQQILEAVLHCHQMGVVHRDLKPENLLLASKCKGAAVKLADFGLAIEVQGEQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPASITTAATSTALGLVEQAKSLLNKKTDVGKPQTNSTKNSAGVTSPKGPIPPAALETQTTVIHNLVDGIKESSDSTHTNPEDEEMKARKQEIIKITEQLIEAVNNGDFEAYAKICDPGLTTFEPEALGNLVEGIDFHRFYFENLLSKNNKPIHTTILNPHVHVVGEDAACIAYIRLTQYIDTQGRPRTSQSEETRVWHRRDGKWQNVHFHCSGAPVAPLQ

SEQ ID NO: 24605 - protein, 332 aa, Phaseolus coccineus
MVVLSQPALNQFFLLKPFKSTPLFTGIPVVDLTHPDAKNLIVNACRDFGFFKLVNHGVPLELMANLENEALRFFKKSQSEKDRAGPPDPFGYGSKRIGPNGDVGWVEYLLLNTNPDVISPKSLCIFRENPHHFRAVVENYITAVKNMCYAVLELMAEGLGIRQRNTLSRLLKDEKSDSCFRLNHYPPCPEVQALNRNLVGFGEHTDPQIISVLRSNSTSGLQICLTDGTWVSVPPDQTSFFINVGDALQVMTNGRFKSVKHRVLADTTKSRLSMIYFGGPALSENIAPLPSVMLKGEECLYKEFTWCEYKKAAYTSRLADNRLAPFQKSAAD

SEQ ID NO: 24606 - protein, 481 aa, Homo sapiens
STLEAMGRKEEDDCSSWKKQTTNIRKTFIFMEVLGSGAFSEVFLVKQRLTGKLFALKCIKKSPAFRDSSLENEIAVLKKIKHENIVTLEDIYESTTHYYLVMQLVSGGELFDRILERGVYTEKDASLVIQQVLSAVKYLHENGIVHRDLKPENLLYLTPEENSKIMITDFGLSKMEQNGIMSTACGTPGYVAPEVLAQKPYSKAVDCWSIGVITYILLCGYPPFYEETESKLFEKIKEGYYEFESPFWDDISESAKDFICHLLEKDPNERYTCEKALSHPWIDGNTALHRDIYPSVSLQIQKNFAKSKWRQAFNAAAVVHHMRKLHMNLHSPGVRPEVENRPPETQASETSRPSSPEITITEAPVLDHSVALPALTQLPCQHGRRPTAPGGRSLNCLVNGSLHISSSLVPMHQGSLAAGPCGCCSSCLNIGSKGKSSYCSEPTLLKKANKKQNFKSEVMVPVKASGSSHCRAGQTGVCLIM

SEQ ID NO: 24607 - protein, 301 aa, Plasmodium falciparum
MSSDIKTNFAADFLMGGISAAISKTVVAPIERVKMLIQTQDSIPEIKSGQVERYSGLINCFKRVSKEQGVLSLWRGNVANVIRYFPTQAFNFAFKDYFKNIFPRYDQNTDFSKFFCVNILSGATAGAISLLIVYPLDFARTRLASDIGKGKDRQFTGLFDCLGKIYKQTGLLSLYSGFGVSVTGIIVYRGSYFGLYDSAKALLFTNDKNTNIVLKWAVAQSVTILAGLISYPFDTVRRRMMMMSGRKGKEEIQYKNTIDCWIKILRNEGFKGFFKGAWANVIRGAGGALVLVFYDELQKLI

SEQ ID NO: 24608 - protein, 438 aa, Sorghum bicolor
MANGGGQAVDGKLIQTFHKSFVQVQSLLDQNRMLISEINQNHESRAPDNLTRNVGLIRELNNNIRRVVGLYADLSASFARTMDASSDGDSSGTAIRSSAAAAAAAGHKRIRWDGWKNFGWVTKQGYSSKHLEWKLFAAQFQVYYCTRRTLVETLQMGQLRSHSYKMSLHIKNDDYRLESLHYPHRKVTTTSMATILLTHWCTFCFQIRDSLLGSTDIVDHASFYKSCSHIIKYSWLHNEHRNSGNEHHARAISSRDVHPPGAILFSCLVTYSSIFMQSCLQNMITINLCSEPSELDQRLKQRLKSCRKALLIDKDEPETTVNRKYGTLSNRSKSPTLCGPSQLPPRPQAHYRTNSVQLQIDHHELQQYLFNGRAWRSSKRIEVLLHATKIPVYICCHSQGRHSHIKDLNDRYAQPTGSLALHPIVCNQEVVLPQKYCC

SEQ ID NO: 24609 - protein, 117 aa, Oryza sativa (japonica cultivar-group); identical to SEQ ID NO: 3369

SEQ ID NO: 24610 - protein, 2470 aa, Saccharomyces cerevisiae
MEPHEEQIWKSKLLKAANNDMDMDRNVPLAPNLNVNMNMKMNASRNGDEFGLTSSRFDGVVIGSNGDVNFKPILEKIFRELTSDYKEERKLASISLFDLLVSLEHELSIEEFQAVSNDINNKILELVHTKKTSTRVGAVLSIDTLISFYAYTERLPNETSRLAGYLRGLIPSNDVEVMRLAAKTLGKLAVPGGTYTSDFVEFEIKSCLEWLTASTEKNSFSSSKPDHAKHRALLIITALAENCPYLLYQYLNSILDNIWRALRDPHLVIRIDASITLAKCLSTLRNRDPQLTSQWVQRLATSCEYGFQVNTLECIHASLLVYKEILFLKDPFLNQVFDQMCLNCIAYENHKAKMIREKIYQIVPLLASFNPQLFAGKYLHQIMDNYLEILTNAPAKKIPHLKDDKPQILISIGDIAYEVGPDIAPYVKQILDYIEHDLQTKFKFRKKFENEIFYCIGRLAVPLGPVLGKLLNRNILDLMFKCPLSDYMQETFQILTERIPSLGPKINDELLNLVCSTLSGTPFIQPGSPMEIPSFSRERAREWRNKSILQKTGESNDDNNDIKIIIQAFRMLKNIKSRFSLVEFVRIVALSYIEHTDPRVRKLAALTSCEIYVKDNICKQTSLHSLNTVSEVLSKLLAITIADPLQDIRLEVLKNLNPCFDPQLAQPDNLRLLFIALHDESFNIQSVAMELVGRLSSVNPAYVIPSIRKILLELLTKLKFSTSSREKEETASLLCTLIRSSKDVAKPYIEPLLNVLLPKFQDTSSTVASTALRTIGELSVVGGEDMKIYLKDLFPLIIKTFQDQSNSFKREAALKALGQLAASSGYVIDPLLDYPELLGILVNILKTENSQNIRRQTVTLIGILGAIDPYRQKEREVTSTTDISTEQNAPPIDIALLMQGMSPSNDEYYTTVVIHCLLKILKDPSLSSYHTAVIQAIMHIFQTLGLKCVSFLDQIIPTILDVMRTCSQSLLEFYFQQLCSLIIIVRQHIRPHVDSIFQAIKDFSSVAKLQITLVSVIEAISKALEGEFKRLVPLTLTLFLVILENDKSSDKVLSRRVLRLLESFGPNLEGYSHLITPKIVQMAEFTSGNLQRSAIITIGKLAKDVDLFEMSSRIVHSLLRVLSSTTSDELSKVIMNTLSLLLIQMGTSFAIFIPVINEVLMKKHIQHTIYDDLTNRILNNDVLPTKILEANTTDYKPAEQMEAADAGVAKLPINQSVLKSAWNSSQQRTKEDWQEWSKRLSIQLLKESPSHALRACSNLASMYYPLAKELFNTAFACVWTELYSQYQEDLIESLCIALSSPLNPPEIHQTLLNLVEFMEHDDKALPIPTQSLGEYAERCHAYAKALHYKEIKFIKEPENSTIESLISINNQLNQTDAAIGILKHAQQHHSLQLKETWFEKLERWEDALHAYNEREKAGDTSVSVTLGKMRSLHALAEWEQLSQLAARKWKVSKLQTKKLIAPLAAGARGGSGEWDMLDEYISVMKPKSPDKEFFDAILYLHKNDYDNASKHILNARDLLVTEISALINESYNRAYSVIVRTQIITEFEEIIKYKQLPPNSEKKLHYQNLWTKRLLGCQKNVDLWQRVLRIRSLVIKPKQDLQIWIKFANLCRKSGRMRLANKALNMLLEGGTILVYQIRSKPPPPVVYAQLKYIWATGAYKEALNHLIGFTSRLAHDLGLDPNNMIAQSVKLSSASTAPYVEEYTKLLARCFLKQGEWRIATQPNWRNTNPDAILGSYLLATHFDKNWYKAWHNWALANFEVISMVQEETKLNGGKNDDDDDTAVNNDNVRIDGSILGSGSLTINGNRYPLELIQRHVVPAIKGFFHSISLLETSCLQDTLRLSTLLFNFGGIKEVSQAMYEGFNLMKIENWLEVLPQLISRIHQPDPTVSNSLLSLLSDLGKAHPQALVYPLTVAIKSESVSRQKAALSIIEKIRIHSPVLVNQAELVSHELIRVAVLWHELWYEGLEDASRQFFVEHNIEKMFSTLEPLHKHLGNEPQTLSEVSFQKSFGRDLNDAYEWLNNYKKSKDINNLNQAWDIYYNVFRKITRQIPQLQTLDLQHVSPQLLATHDLELAVPGTYFPGKPTIRIAKFEPLFSVISSKQRPRKFSIKGSDGKDYKYVLKGHEDIRQDSLVMQLFGLVNTLLKNDSECFKRHLDIQQYPAIPLSPKSGLLGWVPNSDTFHVLIREHRDAKKIPLNIEHWVMLQMAPDYENLTLLQKIEVFTYALDNTKGQDLYKILWLKSRSSETWLERRTTYTRSLAVMSMTGYILGLGDRHPSNLMLDRITGKVIHIDFGDCFEAAILREKYPEKVPFRLTRMLTYAMEVSGIEGSFRITCENVMRVLRDNKESLMAILEAFALDPLIHWGFDLPPQKLTEQTGIPLPLINPSELLRKGAITVEEAANMEAEQQNETRNARAMLVLRRITDKLTGNDIKRFNELDVPEQVDKLIQQATSIERLCQHYIGWCPFW

SEQ ID NO: 24611 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNKLKWRLRAITPCSYIRYFLRKMSKCDQEPSNTLISRSLQVIASTTKGIDFLEFRPSEAAAAVALSVSGELQRVHFDNSSFSPLFSLLQKERVKKIGEMIESDGSDLCSQTPNGVLEVSACCFSFKTHDSSSSYTHLS

SEQ ID NO: 24612 - protein, 498 aa, Cicer arietinum
MGIFSFFAYSLFYLSIFFIFRLLFQSRKFKNLPPGPPSLPIIGNFHHLKRPLHRTFKGLSKTYGDIISLWFGSRLVVVVSSLSEFQQCFTKNDVVLANRPRFLSGKYIFYNYTTLGSTSYSEHWRNLRRITSLDVLSNHRINNFSGVRRDETQRLITKLAEDSSTSFAEVELSFRFYDMTFNNIMRMISGKRYYGEDCDMSDLQEASQFRDMVTELLQLSGANNKTDFMPLLKFFDFENLEKRVKNIADKTDAFLRGLLQEQRNKKERTNTMIDHLLNLQESQPEYYTDQIIKGLALAMLLAGTDSSAVTLEWSMSNLLNHPEVLKKVRDELDTHVGQDRLVDESDLPKLTYLKNVIYETLRLCTPAPLLLPHSTSDDCIIGGYKVPRDTIVLINAWAIHRDPKSWSEATTFKPERFDKKGEIEKVIAFGMGRRVCPGEALALRTISMTLALLIQCFDWKRTSDDMIDMAERDGFVLTKLVPLKAMCKTRPVVNKIFK

SEQ ID NO: 24613 - protein, 520 aa, Phlebia radiata
MHTFLRSTALVVAGLSARALASIGPVTDFHIVNAAVSPDGFSRQAVLAEGVFPGPLIAGNKGDNFQINVIDELTNATMLKTTTIHWHGFFQHGTNWADGPAFINQCPIASGDSFLYNFQVPDQAGTFWYHSHLSTQYCDGLRGPFVVYDPADPYLDQYDVDDDSTVITLADWYHTAARLGSPFPAADTTLINGLGRCGEAGCPVSDLAVISVTKGKRYRFRLVSISCDSFFTFSIDGHSLNVIEVDATNHQPLTVDELTIYAGQRYSFILTADQDVDNYWIRANPGIGITTGFAGGINSAILRYDGADVVEPTTTQATSPVVLSESNLAPLTNAAAPGLPEVGGVDLALNFNLTFDGPSLKFQINGVTFVPPTVPVLLQILSGAQSAADLLPSGSVYALPSNATIELSLPAGALGGPHPFHLHGHTFSVVRPAGSTTYNYVNPVQRDVVSIGNTGDNVTIRFDTNNPGPWFLHCHIDWHLEAGFAVVFAEDIPDVASINPVPQDWSNLCPIYNALDASDH

SEQ ID NO: 24614 - protein, 105 aa, Populus x canescens
AEQAERYEEMVLFMQKLVLGNTPGGELNVEERNLLSVAYKNVIGSLRAAWRIVSSIEQKEEGRKNEDHVVLVKEYRSKVESELSDVCASILRLLDSNLVPLCLFR

SEQ ID NO: 24615 - protein, 125 aa, Populus x canescens
AEQAERYEEMVQFMQKLVIGNTPGGELNVEERNLLSVAYKNVIGSLRAAWRIVSSIEQKEEGRKNEDHVVLVKEYRSKVESELSDICASILRLLDSNLIPSATASESKVFYLKMKGDYRTSPPVP

SEQ ID NO: 24616 - protein, 94 aa, Picea glauca
  unsure (1)..(94): unsure at all Xaa locations
DICRIXLAEQAERYEEMVEFMEKVTKGVEVEELTVEERNLLSVAYKNVIGARRASWRIIWSIEQKEESRGNDEHVVTIREYRSKVESYLSACSA

SEQ ID NO: 24617 - protein, 317 aa, Arabidopsis thaliana
MPVFKAPFNGYSVKFSPFYESRLAVATAQNFGILGNGRIHVLELAPGAPGVTESVSYDTADAVYDVCWSESHDSVLIAANGDGSVKIYDTALPPPSNPIRSFQEHAREVQSVDYNPTRRDSFLTSSWDDTVKLWAMDRPASVRTFKEHAYCVYQAVWNPKHGDVFASASGDCTLRIWDVREPGSTMIIPAHDFEILSCDWNKYDDCILATSSVDKTVKVWDVRSYRVPLAVLNGHGYAVRKVKFSPHRRSLIASCSYDMSVCLWDYMVEDALVGRYDHHTEFAVGIDMSVLVEGLMASTGWDELVYVWQQGMDPRAS

SEQ ID NO: 24618 - protein, 504 aa, Coprinopsis cinerea
QIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGELTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVV

SEQ ID NO: 24619 - protein, 885 aa, Entamoeba histolytica
MQRVYAFEDGDGTNKKLLGGKGAGLCTMTKIGLPVPQGFVITTEMCKQFIANGNKMPEGLMEEVKKNMQLVEKKSGKVFGGEENPLLVSVRSGAAMSMPGMMDTILNLGLNDKTVVALAKLTNNERFAYDSYRRFVSLFGKIALNVDDEVYDKTLENKKVEKGVKLDTELDANDMKELAQVFIKKTEEFTKQPFPVDPYAQLEFAICAVFRSWMGKRAVDYRREFKITPEQADGTAVSVVSMVYGNMGNDSATGVCFTRDPGTGENMFFGEYLKNAQGEDVVAGIRTPQIISKMAEDADLPGCYEQLLDIRKKLEGYFHEVQDFEFTIERKKLYMLQTRNGKMNATATVRTGVDMVEEGLITKEQAIMRIAPQSVDQLLHKNMPANYAEAPLVKGLPASPGAATGAVVFDADDAVEQAKGKKVLLLREETKPEDIHGFFVAEGILTCRGGKTSHAAVVARGMGKPCVSGAEGIKVDVAKKIAKIGSLEVHEGDILTIDGSTGCVYKGEVPLEEPQVGSGYFGTILKWANEIKKIGVFANADLPSAAKKALEFGAEGIGLCRTERMFNAVERLPIVVKMILSNTLEERKKYLNELMPLQKQDFIGLLKTMNGLPVTVRLLDPPLHEFLPTLEELMREIFEMKLSGKTEGLAEKEVVLKKVKELMEVNPMIGHRGIRLGTTNPEIYEMQIRAFLEATAEVIKEGIKTHAEIMIPNVTEVNELINLRKNVLEPVHEEVEKKYGIKVPFMYGTMVECVRAALTADKIATEASFFSFGTNDLTQGTFSYSREDSENKFIPKYVELKILPANPFEILDRPGVGEVMRIAVTKGRQTRPELLVGICGEHGGEPSSIEWCHMIGLNYVSCSSYRIPVARIAAAQAQIRHPREN

SEQ ID NO: 24620 - protein, 155 aa, Picea glauca
MASADVEFRCFVGGLAWSTDDRSLQEAFSPYGEVVESKIISDRETGRSRGFGFVTFNDEQSMRDAIDAMNGKMLDGRSITVNPAQSRGNGGGGGGGGSRGYRGGGGGGGYGGSRDRGDRGYGGGGGGYGGGGGGYGGGGGSRYGGGGSEGGSWRR

SEQ ID NO: 24621 - protein, 506 aa, Hordeum vulgare subsp. vulgare
MEVEAGAHGDTAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKRGDMAKDKFSKVLWGAVTNYRTWIFVLLYGYCMGVELTTDNVIAEYYFDHFHLDLRAAGTIAACFGMANIVARPMGGYLSDLGARYFGMRALWNIWILQTAGGAFCIWLGRASALPASVTAMVLFSICAQAACGAIFGVAPFVSRRSLGIISGLTGAGGNVGAGLTQLLFFTSSQYSTGRGLEYMGIMIMACTLPVALVHFPQWGSMFFPASADATEEEYYASEWSEEEKGKGLHIAGQKFAENSRSERGRRNVIFATSATPPNNTPQQV

SEQ ID NO: 24622 - protein, 507 aa, Hordeum vulgare subsp. vulgare
MEVEAGAHGDAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTGNVIAEYYFDHFHLNLRAAGTIAACFGMANIVARPMGGYLSDLGARYFGMRARLWNIWILQTAGGAFCIWLGRASALPASVTAMVLFSICAQAACGAIFGVEPFVSRRSLGIISGLTGAGGNVGAGLTQLLFFTSSQYSTGRGLEYMGIMIMACTLPVALVHFPQWGSMFLAASADATEEEYYASEWSEEEKSKGLHIAGQKFAENSRSERGRRNVILATSATPPNNTPLHV

SEQ ID NO: 24623 - protein, 197 aa, Lycopersicon esculentum
MAELEAKKVEIVDPAPAQEPVEAPKEVVADEKAIVEPAPPPPAEEKEKPDDSKALVVVENKAEEAADEKKEGSIDRDAVLARVATEKRLSLIKAWEESEKSKAENKAQKKVSAIGAWENSKKANLESELKKMEEQLEKKKAIYTEKMKNKIALLHKEAEEKRAMIEAKRGEDLLKAEELAAKYRATGTAPKKILGIF

SEQ ID NO: 24624 - protein, 608 aa, Medicago sativa
MQKDQLKKDVKEVKFFTDYGDANRYKILEVVGKGSYGVVCAAIDTHTGGKVAIKKIHDVFEHISDAIRILREVKLLRLLRHPDIVEIKRIMLPPSKREFKDIYVVFELMESDLHQVIKANDDLTREHQQFFLYQMLRALKFMHTANVYHRDLKPKNILANANCKLKVCDFGLARVAFNDTPTTTFWTDYVATRWYRAPELCGSFFAKYTPAIDIWSIGCIFAEVLTGKPLFPGKSIVHQLDLITDLLGTPPPEIISGVRNEKARKYLMEMRKKLPVPFERKFPNADPLALRLLQRLLAFDPKDRPTAQEALADPFFKGLAKIEREPSSQPISRMEFDFERRRVSKDDIKELIYREILEYHPQLLKDYISGTEGTNFMYPSAIDQFRKQFAYLEENNGKCGPVIPPERKHVSLPRSTVLSSTIPPSTQPSFAPYANRQITQEAFSIPRAAESNSLSQSKGLRPPPRAPAAKSGRVTGPVLYDNGRSTKDNYDARIFYQNAIPQAISPHCFQRVANAHQTSTKTTPETYKDNSQGKHQLSPKKCNVPARPAFDLNTNPYHQQSKNDLLNDPVTVIDAKLLKAQSQFGAAGAAAVAVAAHRHSAGFQYGLT

SEQ ID NO: 24625 - protein, 806 aa, Gossypium hirsutum
  unsure (1)..(806): unsure at all Xaa locations
MAERALTRVHSLRERLDETLLAHRNEILALLSRIEGKGKGILQHHQIILEFEAIPEENRKKLANGAFFEVLKASQEAIVLPPWVALAVRPRPGVWEYIRVNVHALVVEELTVAEYLHFKEELVDGSSNGNFVLELDFEPFNSSFPRPTLSKSIGNGVEFLNRHLSAKLFHDKESMHPLLEFLRVHCHKGKNMMLNDRIQNLNALQHVLRKAEEYLGTLPPETPCAEFEHRFQEIGLERGWGDTAERVLEMIQLLLDLLEATDPCTLEKFLGRIPMVFNVVILTPHGYFAQDNVLGYPDTGGQVVYILDQVRALENEMLLRIKQQGLNITPRILIITRLLPDAVGTTCGQRLEKVYGTEHSDILRVPFRTEKGIVRKWISRFEKVWPYLETYTEDVAHEISKELHGTPDLIIGNXSDGNIVASLLAHKLGVTQCTIAHALEKTKYPDSDIYWKKLEDKYHFSCQFTADLFAMNHTDFIITSTFQEIAGSKDTVGQYESHTAFTLPGLYRVVHGIDVFDPKFNIVSPGADMEIYFPYTEEKRRLKHFHPEIEDLLYTKVENEEHLCVLNDRNKPILFTMPRLDRVKNLTGLVEWCGKNPKLRELANLVVVGGDRRKESKDLEEKAEMKKMFELIDKYNLNGQFRWISSQMNRIRNVELYRYICDTKGAFVQPALYEAFGLTVVEAMTCGLPTFATCNGGPAEIIVHGKSGFNIDPYHGDQAADILVDFFEKCKKDPSHWDKISQGGLKRIEEKYTWKIYSERLLTLTGVYGFWKHVSNLERRESRRYLEMFYALKYRKLAESVPLAEE

SEQ ID NO: 24626 - protein, 394 aa, Drosophila melanogaster
MAAATPEIQFYERELNIRRVIEECDLQRLDQALNICDLSSVERNVRLWQKLLPRIKPFYAVKCNDDPMVVRLLAQLGAGFDCASKNEVKLVLGFDVSPERIIFANPCRPVSHLEYAKEHQVSNGTVDNEFEVYKLHTHYPNSNLIVRFKSEAKEAQCPLGDKFGCDADVDAAALMLLAKSLELKVTGTSFHVGSGCSELQAYDRAIKKAKNLFKFGALLGYDMDFLDIGGGFPGSDDVKFEQIAESVNTSVQRHFPDERVHIIAEPGRFFVAAACTLVCKIHAKREIRNEAGKLDTVMYYLNDGVYGSFNCILYDHQVVIAEHYQDNAESLPHLKSLIWGPSCDALDQISEDLHLPNLNRGDLLGFRNMGAYTMPIASAFNGFEVPKTLYFQAI

SEQ ID NO: 24627 - protein, 848 aa, Brassica oleracea
YHHSYTFSFLLVFLVLILFHPALSIYVNTLSSSESLTISSNRTLVSPGGVFELGFFKPLGRSRWYLGIWYKKVSQKTYAWVANRDSPLTNSIGTLKISGNNLVLLGQSNNTVWSTNITRGNARSPVIAELLPNGNFVMRYSNNKDPSGFLWQSFDFPTDTLLPEMKLGYDLKTGRNRFLTSWKGSDDPSSGNFVYKLDIRRGLPEFILINTFLNQRVETQRSGPWNGIEFSGIPEVQGLNYMVYNYTENSEEIAYSFHMTNQSIYSRLTLTEFTLDRFTWIPPSWGWSLFWTLPTDVCDPLYLCGSYSYCDLITSPNCNCIRGFVPKNPQQWDLRDGTQGCVRTTQMSCSGDGFLRLNNMNLPDTKTATVDRTIDVKKCEERCLSDCNCTSFAIADVRNGGLGCVFWTGELIAIRKFAVGGQDLYVRLDAADLDISSGEKRDRTGKIIGWSIGVSVMLILSVIVFCFWRRRQKQAKADATPIVGNKVLMNEVVLPRKKRDFSGEEEVENLELPLMEFEAVVTATEHFSDFNKVGKGGFGVVYKGRLVDGQEIAVKRLSEMSAQGTDEFMNEVRLIAKLQHYNLVRLLGCCVYEGEKILIYEYLENLSLDSHLFDETRSCMLNWQMRFDIINGIARGLLYLHQDSRFRIIHRDLKASNVLLDKDMTPKISDFGMARIFGRDETEADTRKVVGTYGYMSPEYAMNGTFSMKSDVFSFGVLLLEIISGKRNKGLCDSDSSLNLLGCVWRNWKEGQGLEIVDRVIIDSSSPMFRPREISRCLQIGLLCVQERVEDRPMMSSVVLMLGSEAALIPQPKQPGYCVSGSSLETYSRRDDENCTVNQITMSIIDAR

SEQ ID NO: 24628 - protein, 849 aa, Brassica oleracea
YHHSYTFSFLLVFLVLILFHPALSIYVNTLSSSESLTISSNRTLVSHGGVFELGFFKPLGRSRWYLGIWYKKVSQKTYAWVANRDSPLSNSIGTLKISGNNLVLLGQSNNTVWSTNLTRENVRSPVIAELLPNGNFVMRYSSNKDSSGFLWQSFDFPTDTLLPEMKLGYDFKTGRNRFLTSWRSYDDPSSGKFTYELDIQRGLPEFILINRFLNQRVVMQRSGPWNGIEFNGIPEVQGLNYMVYNYTENSEEIAYTFHMTNQSIYSRLTVTDYALNRYTRIPPSWGWSMFWSLPTDVCDSLYFCGSYSYCDLNTSPYCNCIRGFVPKNRQRWDLRDGSHGCVRRTQMSCSGDGFLRLNNMKLPDTKTATVDRTTDVKKCEEKCLSDCNCTSFATADVRNGGLGCVFWTGDLVEIRKQAVVGQDLYVRLNAADLASGEKRDRTKKIIGWSIGVTVMLILSVIVFCFWRRRQKQAKADATPIVGNQVLMNEVVLPRKKINFSGEDEVENLELSLEFEAVVTATEHFSDFNKVGKGGFGVVYKGRLVDGQEIAVKRLSEMSAQGTDEFMNEVRLIAKLQHNNLVRLLGCCVYEGEKILIYEYLENLSLDSHLFDETRSCMLNWQMRFDIINGIARGLLYLHQDSRFRIIHRDLKASNVLLDKDMTPKISDFGMARIFGRDETEADTRKVVGTYGYMSPEYAMNGTFSMKSDVFSFGVLLLEIISGKRNKGFCDSDSNLNLLGCVWRNWKEGQGLEIVDRVIIDSSSPTFRPREILRCLQIGLLCVQERVEDRPMMSSVVLMLGSETALIPQPKQPGYCVSQSSLETYSSWSKLRDDENWTVNQITMSIIDAR

SEQ ID NO: 24629 - protein, 750 aa, Methanococcus maripaludis
DLRNDDVDIAGGKGASLGEMWNAKLPVPPAFVVTSEAYRYFIKETKLQDEIERILSNIDVNNNEELNKASKEVRYAIENVKIPDDLKLSIIESYHKMCELSGDDETFVAVRSSATAEDLPDASFAGQQETFLNMKGNEQVLQAVQECFSSLFTPRAIFYREEKGFDHFEVALAAVVQKMVNADQAGVMFTVNPINQDYNQMVIEGAWGLGEGVVSGTVSPDTYIVAKDTQEILSVNVARKDTMFIKDADGVTKEIKTSEDLIEKQVLSEEMIKKLENVGQTIENHYKRPMDIEWSIENGEIYMLQARPITTLTDKKDSKSSNEIEGKIILKGIGASPGVESGKVKIISEIEEIGRILDGDILVTKMTTPDMVPAMKKAAAIITDDGGLTCHAAIISRELGTPCVVGTKGATKNLKDEECVTVDGEKGIVYEGKIGKPEEKAPAQVVYAGAPVITATEIKANVSMPEVAERAAATGADGVGLLRAEHMILGTGVHPGKILNEQGEGALTEVFAEGIRKVADAFYPRPVTYRTLDAPTDEFVGLKGGEDEPHEHNPMMGWRGIRRGLDQSEILKCELKAIKKLREDGYRNINVMIPLVTNVDEIRKVKEIANEVGLKLRQDVEFGVMVETPAAALIIDDIIEEGIDFISLGTNDLTQYTIAIDRNNENVSKYYLENHPAVLKLIELVITSCKSAGVKTSICGQAGSRPQIVEKLVEWGITSISANIDAVETIRNVVARTEQKIILESIRKQK

SEQ ID NO: 24630 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 24631 - protein, 1104 aa, Takifugu rubripes
MFNSGSSLKSKIRQVYNEKETNELVAIKKFKDSEENEEVKETTLRELKMLRTLKQDNIVELKEAFRRRGKLYLVFEYVERNMLELLEEHPTGAPPDKVRSYIYQLIKAINWCHKNEIVHRDIKPENLLISSDDILKLCDFGFARNLSEGTDANYTEYVATRWYRSPELLLGAPYGKAVDMWSVGCILGELSDGQPLFPGESEIDQLFTIQKVLGPLPAEQMKLFYNNPRFHGIRFPSVTHPQTLERRYQGILSGLMLDLMKNLLLLNPTERYLTEQSLNHPAFQPLRQVERERPAPPASPNPPRSSKRKTHHHGENTVPTRSHSKSTSRRSNSKECSSLPRHGDLHHLGSKSFLNGNKPPPSSLSPTLHPKSQYMSQTLNRSPSSSKDLVNNNLPHLLSPKEVKGKTEFDFNLGPSPKLPDQGHGAKYSHSKPSSSRSQQQQQQLQQQQQQQLQQQQLQLQQQQQQLQQQQLQQQQQQQQQQAIRHTFLENKNNTLQSGAEKQHSRHTHSMADSAHGSMSSSSKSSASYLSLSKSHSALSDAKSVGNLSDGRLHPDDPNSNTAGLGPGARFFPTSCLDLNAPTGPPGPPGSPSARHSDRSGHSPASRSSGNIRMESSTLDSSSRHKSRHKSSAPEEAGAPELLDPGGAAMPSTHTLPSPHESYHYGLGYTSPFSSQQRPQRHSMYVRRERHRPHGVEGGMAGLPAPGQGIPMRASSLQLLSPQLQHRTTLTGHSVSSSREDCTDDMTRSEQSPKDMGHPCAPIKDSARDNTAAFHTQRSKNEAGLYHDPHGEDGASSKENRMIFTESMPRRVGSFYRVPSPRPDNSSSFHDAVGQGRVPVGPVVPVDPVAMVGHSKRQTAFDWTAAEAMVMNPLEPVKEKEKQGFFRAIKKKKKKTQLVPGNGQEHLSLQRSTKSSSHHSSRRKNRERSRDRHREREQSRDRDRERERERERDRERERERGRELERSQPLKSLRRLLHLSPSSSNQRQQSPASPAPPPDLRFQAPLPNPPQPPSKAGYPETRGHADSRGHSGVSSSSQPKSRKASYPIPGQIESSWHVSALQRAEGAQFTPEQLGIKPGQNGPTFTRASRTRIPNLNDLKETAL

SEQ ID NO: 24632 - protein, 375 aa, Serratia marcescens
MKAFLLAIVRRKYRPDGGAERFVSRALKALEQQDLDLNVITREWQGDANPNWHIHLCNPLKLGRISRERGFAVAARALWQKERFDLVQSHERIPGCDIYRAGDGVHRRWLLQRARLLPEWRRKWLFSNRYHRYVMCAERAMYAAPELKAVICNAEMIKREIIADFGVPADKITVIYNAIDNQKFPPADEAQRRRLREQYQIPQQAHCLIFVGSGFERKGLAAAIRAVAATDSHLLVVGKDKAEKRYRALAQSLGCGDRIHFMGVQKQTLPFYQAADALLLPTLYDPFPNVILEAMSCGLPVITSTTCGGAEFITPGQNGFVTDALDVPAITEAIRALPRQALGSSMGEAARLRIMTATPAHLSEQLISLYNRLLD

SEQ ID NO: 24633 - protein, 345 aa, Spodoptera littoralis
MFRASFILLLACCGAMSATIDVPMLKMLNDREMPAIALGTYLGFDKGGAVTSKDKQLRNVVMQAIDLGYRHFDTAAIYNTEAEVGEAIRMKIDEGVIKREDVFLTTKLWNTHHKREQVAVAMKETLNKTGLDYVDLFLMHWPIALNEDYSHSNTDYLETWRATEEMVKLGYTKSIGLSNFNKLQVATVLQECTIKPVALQIEVHPQIIQEDLITYAKDEGIIVMGYSPFGSLVKRFGMDLPGPKMDDPVLTSLAKKYEKTPAQIVLRWLVDRKVVPIPKTVSPKRLLENINIFDFKLKEEEIEKINQFNSNTRYTLPSFWQKHPFYPFDMVPNPIPDPFRSEMKS

SEQ ID NO: 24634 - protein, 421 aa, Gallus gallus
MASFPLSVNEKLIARSRAVGELLAPTSPFDKKCGRENWTVAFAPDGSYFAWSQGHRIVKLVPWSQCLTNFLLHGTKNVANSANARLSRQNSDGSQRNKPCEHIIDCGDIVWSLAFGSSVPEKQSRCVNIEWHRFKFGQDQLLLATGLNNGRIKIWDVYTGKLLLNLMDHTEVVRDLTFAPDGSLILVSASRDKTLRVWDLKDDGNMMKVLRGHQNWVYGCAFSPDSSILCSVGASKAVFLWDMDKYSMIRKLEGHHNDVVACEFSPDGALLATASYDTRVYVWDPYIGVILREFGHLFPPPTPIFAGGANDRWVRSVSFSHDGLHIASLADDKMVRFWRIDEEYPVQVAPLNNGLCCTFSTDGSVLAAGTQDGSVHFWATPRQVSSLQHLCRMAIRRVMPTSQVKNLPTPSKVVEFLCYQI

SEQ ID NO: 24635 - protein, 398 aa, Homo sapiens
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIAIKNKYASSKLLKISMIPQLNSKAVKDLASPLIGRS

SEQ ID NO: 24636 - protein, 233 aa, Homo sapiens
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDADDSNNCTGQNEHQRENSGHRRDQIIEKDAALCVLIDEMNERP

SEQ ID NO: 24637 - protein, 729 aa, Homo sapiens
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 24638 - protein, 1065 aa, Homo sapiens
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 24639 - protein, 355 aa, Homo sapiens
MAGCCCLSAEEKESQRISAEIERQLRRDKKDARRELKLLLLGTGESGKSTFIKQMRIIHGSGYSDEDRKGFTKLVYQNIFTAMQAMIRAMDTLRIQYVCEQNKENAQIIREVEVDKVSMLSREQVEAIKQLWQDPGIQECYDRRREYQLSDSAKYYLTDIDRIATPSFVPTQQDVLRVRVPTTGIIEYPFDLENIIFRMVDVGGQRSERRKWIHCFESVTSIIFLVALSEYDQVLAECDNENRMEESKALFKTIITYPWFLNSSVILFLNKKDLLEEKIMYSHLISYFPEYTGPKQDVRAARDFILKLYQDQNPDKEKVIYSHFTCATDTDNIRFVFAAVKDTILQLNLREFNLV

SEQ ID NO: 24640 - protein, 536 aa, Homo sapiens
MKQSSNVPAFLSKLWTLVEETHTNEFITWSQNGQSFLVLDEQRFAKEILPKYFKHNNMASFVRQLNMYGFRKVVHIDSGIVKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAQKKNLFQHIVKEPTDNHHHKVPHSRTEGLKPRERISDDIIIYDVTDDNADEENIPVIPETNEDVISDPSNCSQYPDIVIVEDDNEDEYAPVIQSGEQNEPARESLSSGSDGSSPLMSSAVQLNGSSSLTSEDPVTMMDSILNDNINLLGKVELLDYLDSIDCSLEDFQAMLSGRQFSIDPDLLVDLFTSSVQMNPTDYINNTKSENKGLETTKNNVVQPVSEEGRKSKSKPDKQLIQYTAFPLLAFLDGNPASSVEQASTTASSEVLSSVDKPIEVDELLDSSLDPEPTQSKLVRLEPLTEAEASEATLFYLCELAPAPLDSDMPLLDS

SEQ ID NO: 24641 - protein, 1130 aa, Homo sapiens
MKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVGLSQDAQDQMRKMLCQKESNYIRLKRAKMDKSMFVKIKTLGIGAFGEVCLARKVDTKALYATKTLRKKDVLLRNQVAHVKAERDILAEADNEWVVRLYYSFQDKDNLYFVMDYIPGGDMMSLLIRMGIFPESLARFYIAELTCAVESVHKMGFIHRDIKPDNILIDRDGHIKLTDFGLCTGFRWTHDSKYYQSGDHPRQDSMDFSNEWGDPSSCRCGDRLKPLERRAARQHQRCLAHSLVGTPNYIAPEVLLRTGYTQLCDWWSVGVILFEMLVGQPPFLAQTPLETQMKVINWQTSLHIPPQAKLSPEASDLIIKLCRGPEDRLGKNGADEIKAHPFFKTIDFSSDLRQQSASYIPKITHPTDTSNFDPVDPDKLWSDDNEEENVNDTLNGWYKNGKHPEHAFYEFTFRRFFDDNGYPYNYPKPIEYEYINSQGSEQQSDEDDQNTGSEIKNRDLVYV

SEQ ID NO: 24642 - protein, 896 aa, Homo sapiens
MLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVAPRVQAGLLDFLLFGSLISAVDPVAVLAVFEEVHVNETLFIIVFGESLLNDAVTVVLYKVCNSFVEMGSANVQATDYLKGVASLFVVSLGGAAVGLVFAFLLALTTRFTKRVRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 24643 - protein, 234 aa, Entodinium caudatum
DKYEKQVYLAMLAEQCSRYEDMMTFLEDMVKAKAEDLSSDERNLLSIAYKNTISLDRQAIRTLLAYESKEAKKAESPYLDYIKEYKAKVQKELEDLCNKINRTIDDNLLPKATTDEAKVFYHKMKGDYCRYIAENVDGDTKKKYSDEGLAAYNAALEAAKNIDYKNPVKLGLALNLSVFYYEVVGNKDEACKLAEDTLSKSKEALNGADEEEDEVKDAMSIVNLLEENLGMGER

SEQ ID NO: 24644 - protein, 233 aa, Entodinium caudatum
YLAMLAEQCSRYKEMVQFLEDMVKQRDKDLNSDERNLLSIAYKNSISGGRSAVRTIMAYEAKEKKKENSTFLPYITEYKKQVEDELTKLCQGVLKTTDEQLLKKAEDDEAKVFYIKMKGDYNRYIAEYAEGDLKKQVSDDALKAYDEATEIAKTLPVLNPIALGLALNFSVFYYEVINDHKKAIEIAKAAVEKADKELPNIDEDADENRDTVSIYNLLKENLDMWVSEEEGDQ

SEQ ID NO: 24645 - protein, 288 aa, Plasmodium vivax
MEKYHGLEKIGEGTYGVVYKAQNNYGETFALKKIRLEKEDEGIPSTAIREISILKELKHSNIVKLYDVIHTKKRLILVFEHLDQDLKKLLDVCDGGLESVTAKSFLLQLLSGIAYCHEHRVLHRDLKPQNLLINREGELKIADFGLARAFGIPVRKYTHEVVTLWYRAPDILMGSKKYSTPIDMWSVGCIFAEMVNGRPLFPGVSETDQLMRIFRILGTPNSENWPNVTELPKYDPDFMVYEPLPWETFLKGLDDTGIDLLSKMLRLDPNQRITAKQALEHAYFKESN

SEQ ID NO: 24646 - protein, 2035 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 24647 - protein, 462 aa, Rhodobacter capsulatus
MADYIVKDIKLAEFGRKELDIAETEMPGLMACREEFGPSQPLKGARIAGSLHMTIQTAVLIETLKALGADVRWASCNIFSTQDHAAAAIAAGGTPVFAVKGETLEEYWAYTDKIFQFPEGTCNMILDDGGDATLYILLGARVEAGETDLIATPTSEDEVCLFNQIKKRMVESPGWFTQQRAAIKGVSEETTTGVHRLYDLHKKGLLPFPAINVNDSVTKSKFDNKYGCKESLVDGIRRATDVMMAGKVAVVCGYGDVGKGSAASLRGAGARVKVTEVDPICALQAAMDGFEVVVLEDVVADAIFITTTGNKDVIRIEHMREMKDMAIVGNIGHFDNEIQVAALKNHKWTNIKDQVDMIEMPSGARIILLSEGRLLNLGNATGHPSFVMSASFTNQVLAQIELWTKGAEYQPGVYILPKSLDEKVARLHLKKIGVKLTTLRPDQAEYIGVTVEGPFKSDHYRY

SEQ ID NO: 24648 - protein, 791 aa, Drosophila melanogaster
MRWELRYGWQIVTFRTNCATAAAVACHQLLCPVSLTSAVEIMPNSFPPEGRRRERRSGNLVLRAGCCCIGKYFLHNRCASSVKKECTLGEYSELIVPPTAICPAVLDRQRSVNQAHKATHFQITPPDELSCPLLVFVNPKSGGRQGDRILRKFQYMLNPRQVYDLSKGGPKEGLTLFKDLPRFRVICCGGDGTVGWVLEAMDSIELASQPAIGVIPLGTGNDLARCLRWGGGYEGENIPKLMDKFRRASTVMLDRWSIEVTNTPHSDDMRPKVTLHSNMQKVIELSQSVVVDKSLMERFEEIQRQSKQVATSMGTAASSTSIMMASKTETEMETMATMEFGSSTTTTNRTTTTKSISMSTFETQCLQQTLRTATSSSSSNTSSGSPCNGNQDAETEVDSHAAAAADVREKSVPRRSGETEKQSLETLLLQHKQQMQQQQQQQQQGVTSLAVEEAATATPVGSNQSDNSSQRNKQNNILKQQITLSLDLSDHEDEPKDDGGGAGDGTKSNGNSIPATPATPITPTTPNAASSVLQQQQQQHLQFEQQQKPIKVQSDKDCTVPYNIINNYFSVGVDAAICVKFHLEREKNPHKFNSRMKNKLWYFEYATSETFAASCKNLHESIEIVCDGVALDLANGPHLQGVALLNIPYTHGGSNLWGEHLSQKRIRKSAGPFGKSKKLRAGDKEFSATSFNSVDLSVAIQDFGDRLIEVIGLENCLHMGQVRTGLRASGRRLAQCSEVIIKTKKTFPMQIDGEPWMQMPCTIKVTHKNQVPMLMAPRSEKGRGFFNLLCS

SEQ ID NO: 24649 - protein, 182 aa, Octopus dofleini
MEAFNVHGLVGKIIDRVPHKQLSIRYGNTEVQPGMNLTPSMTKHQPQIKFEAETNVYYTLIMNDADFPSRSDQKLNEFQHWLVVNIPGSDISRGDVLTDYIGPLPNKGTGYHRYVLMLFKQSKGRMEFRGEKKINNRTSEGRKSYNMMEFARKHFLVEPVYGNFFQSEWDDSVPKIYEQLKM

SEQ ID NO: 24650 - protein, 388 aa, Zymomonas mobilis
MSQPRTVTVLGATGSIGHSTLDLIERNLDRYQVIALTANRNVKDLADAAKRTNAKRAVIADPSLYNDLKEALAGSSVEAAAGADALVEAAMMGADWTMAAIIGCAGLKATLAAIRKGKTVALANKESLVSAGGLMIDAVREHGTTLLPVDSEHNAIFQCFPHHNRDYVRRIIITASGGPFRTTSLAEMATVTPERAVQHPNWSMGAKISIDSATMMNKGLELIEAYHLFQIPLEKFEILVHPQSVIHSMVEYLDGSILAQIGSPDMRTPIGHTLAWPKRMETPAESLDFTKLRQMDFEAPDYERFPALTLAMESIKSGGARPAVMNAANEIAVAAFLDKKIGFLDIAKIVEKTLDHYTPATPSSLEDVFAIDNEARIQAAALMESLPA

SEQ ID NO: 24651 - protein, 102 aa, Gossypium hirsutum
CRHSLPDGLMRATDVMIAGKVAVVCGYGDAGKGCAAALKQAGARVIVTEIDPICALQALMEGLQVLTLEDVVSEADIFVTTTGNKDIIMVNHMRKMKNNAVV

SEQ ID NO: 24652 - protein, 130 aa, Oryza sativa
TFGPPHHPLLANPVNHRNIRILPPEHATIMDFSRLYEVSNVVDEHRDMRLDIDSMTYEELLALEEQIGDVNTGLAKSYIVEKLKTSLFVPGSSCMSNKSSESSMENDACIICQEEYQVKECIGTLDCGHR

SEQ ID NO: 24653 - protein, 381 aa, Homo sapiens
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 24654 - protein, 394 aa, Schizosaccharomyces pombe
MKTHLLANKLYQKGLRRQNYLQICKLICHARTVLSDVSNVGKNNADEKDTKKAKRSFDESNLSTNEEADKPVESKFVKKLKVYSKNADPSVETLQKDRALMLMNHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAMYLSRRLLRRGPWTAKLVESSGGYEEHELKEIAYIMLHYHNKPLEHKAFFQKYSSKRFLKASIFVHQLVRQRYSVNRTDDDDLQSEPSSSLTNDGQRTLL

SEQ ID NO: 24655 - protein, 818 aa, Sus scrofa domestica
MLLWSGICGLSPPRIFPSLLVVVALVGLLPVLRSHGLQPSPTASTIRGSEPPRERSIGDVTTAPPELAPESRPVNHSVTEHGMKARKAFPVLGIDYTHVRTPFEISLWILLACLMKIGFHVIPTISSIVPESCLLIVVGLLVGGLIKAVGETPPFLQSEVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYDRVGIVDIVLGFLSFFVVSLGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGHLLDKNHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKTLPTERILPALSKDKEEEIRKILRNNLQKTRQRLRSYNRHTLVADPYEEAWNQMLLRRQKARQLEQKINNYLTVPAHKLDSPTMSRARIGSDPLAYEPKADLPVITIDPASPQSPESVDLVNEELKGKVLGLSREPGRATEEEDDDEDHDGGLVMRTKEPSSPGTDDVFTPAPSDSPSSQRIQRCLSDPGPHPEPGEGEPFIPKGQ

SEQ ID NO: 24656 - protein, 261 aa, Pisum sativum
MATAPTPREEFVYMAKLAEQAERYEEMVEFMEKVTAAVESEELTVEERNLLSVAYKNVIGARRASWRIISSIEQKEESRGNDEHVTVIRDYRSKIETELSNICNGILKLLDSRLIPSAALGDSKVFYLKMKGDYHRYLAEFKSGAERKDAAESTLTAYKSAQDIANTELPPTHPIRLGLALNFSVFYYEILNSPDRACGLAKQAFDEAIAELDTLGEESYKDSTLIMQLLRDNLTLWTSDMQDDGADEIKEAAPKGNDEPQ

SEQ ID NO: 24657 - protein, 257 aa, Pseudomonas putida
MNKRFQGKVAVITGAAQGIGRRVAERMAAEGGRLLLVDRSELIHELADELVGVAEVLTLTADLEQFAECQRVMAAALERFGRLDILINNVGGTIWAKPFEHYQEREIEAEVRRSLFPTLWCCHAALAPMIEQGSGAIVNVSSVATRGIHRVPYGAAKGGVNALTACLAFETAERGIRVNATAPGGTEARHGGFRNSAEPSEQEKVWYQQIVDQSLDSSLMKRYGSIDEQVEAILFLASDAASYITGITLPVAGGDLG

SEQ ID NO: 24658 - protein, 376 aa, Lymnaea stagnalis
MGCFRQTRDDEDDKLRKEANKKIEKQLAKDKLLYRGTHRLLLLGAGESGKSTIVKQMRILHVNGLSPEERKQKIEDIKRNVRDAILTITGAMSNLNPPVQLEHPQNKAKVDYIQDKASQAEFDYPPIFYEYTEILWKDKGVQAAFERSNEYQLIDCAQYFLDRVHIIRQAEYTPSEQDILRCRVLTSGIFETKFSVDKVNFHMFDVGGQRDERRKWIQCFNDVTAIIFVTACSGYNMVLREDATQNRLKESLDLFKSIWNNRWLRTISVILFLNKQDLLAEKVKAGKSKIEDYFPEYARYQVPPDASSEPGEDTEVVRAKYFIRDEFLRISTASGDGRHYCYPHFTCAVDTENIRRVFNDCRDIIQRMHLRQYELL

SEQ ID NO: 24659 - protein, 385 aa, Arabidopsis thaliana
MVEQTQHPTILQKVSGQLLSSSVSQDIRGYASASKRPATYQKHAAYGNYSNAAFQYPLVAASQIATTTSPVFVQAPGEKGFTNFAIDFMMGGVSAAVSKTAAAPIERVKLLIQNQDEMLKAGRLTEPYKGIRDCFGRTIRDEGIGSLWRGNTANVIRYFPTQALNFAFKDYFKRLFNFKKDKDGYWKWFAGNLASGGAAGASSLLFVYSLDYARTRLANDSKSAKKGRGERQFNGLVDVYKKTLKSDGIAGLYRGFNISCAGIIVYRGLYFGLYDSVKPVLLTGDLQDSFFASFALGWLITNGAGLASYPIDTVRRRMMMTSGEAVKYKSSFDAFSQIVKKEGAKSLFKGAGANILRAVAGAGVLAGYDKLQLIVFGKKYGSGGA

SEQ ID NO: 24660 - protein, 419 aa, Homo sapiens
PVRSSAPRRGHSVASAPRSGLRQVAGRRGAALPCSLAPGCGAAAGASPCPGAGRRRAAGGRCLACECTSLTCAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 24661 - protein, 414 aa, Solanum tuberosum
MESRVLTGGATAIRGGLPLLRKPAAVMKFTTAAHAISRDFPAGAVTAKPVGPLIAGPNLIWGRQLRPAILLETSPKRESIKPCSAAASSSAGSSDSSGDAKVGFFNKATLTTGFFFFMWYFLNVIFNILNKKIYNYFPYPYFVSVIHLAVGVVYCLVSWTVGLPKRAPIDSTQLKLLTPVAFCHALGHVTSNASFAAVRVSFTHTVKALEPFFNAAASQFILGQQIPLALWLSLAPVVIGVSMASLTELSFNWLGFTRAMISNISFTYRSIYSKKAMTDMDSTNVYAYISIIALIFCLPPSIFIEGPQLLQHGFNDAIAQVGLTKFVTDLFWVGMFYHLYNQVATNTLERVAPLTHAVGNVLKRVFVIGFSIVIFGNKISTQTGIGTCIAIAGVAIYSFIKAKMEEEKRQKKAA

SEQ ID NO: 24662 - protein, 261 aa, Saccharopolyspora hirsuta
MAANTKPVALVTGATSGIGLAIARRLGQLGARVYICARRAEELATTIKTLQAEGLEVDGSTCDVSVPGQIPELVAAAVDRFGPIDVLVNNAGRSGGGVTVEVDDETWFDVINTNLNSVFLMTKQVLTKGGMLEQERGRIINIASTGGKQGVIWGSPYSASKHGVVGFSKSLGLELAKTGITVNAVCPGFVETPMAERVRAHYSKIWSVSEAEAHDRVTTRVPLGRYVEPEEVAAMVEYLVSDGAAAVTAQALNVCGGLGNY

SEQ ID NO: 24663 - protein, 374 aa, Alligator mississippiensis
STAGKVIKCKAAITWEIKKPFSIEEIEVAPPKAHEVRIKILATGICRSDDHVTAGLLTMPLPMILGHEAAGVVESTGEGVTSLKPGDKVIPLFVPQCGECMPCLKSNGNLCIRNDLGSPSGLMADGTSRFTCKGKDIHHFIGTSTFTEYTVVHETAVARIDAAAPLEKVCLIGCGFSTGYGAAVKDAKVEPGSTCAVFGLGGVGLSTIMGCKAAGASRIIGIDINKDKFAKAKELGATECINPLDCKKPIQEVLSEMTGGGVDYSFEVIGRIDTMTAALACCQDNYGTSVIVGVPPASEKITFNPMMLFTGRTWKGTVFGGWKSKESVPKLVADYMEKKINLDGLITHTLPFDKINEGFELLRTGKSIRSVLTF

SEQ ID NO: 24664 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTIVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 24665 - protein, 158 aa, Ciona intestinalis
MANCKVFVGNLSYNATEDDLRKHFSGSGQVEEVAIICDRETGRSRGFAFVTFSSEGEANDAIENLNESDVAGRNVSVRQAQSKRDGGGGGRGGGGYGGGGYGGGGGGGYGGGGGGGGRYGGSSGYGGGGRRYNDDRGSYGGGDYGGGRSGGGGRSDRY

SEQ ID NO: 24666 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPAEHNWPGISQFPEYKATAPRYATQDLRQILPQIDATGIDLLQRLLQLRPELRISAHDALQHPWFHDILQYQHCQQAAG

SEQ ID NO: 24667 - protein, 200 aa, Ipomoea batatas
FVQLLIKYVVELAKALAKMPGVYRVDLFTRQVSSPEVDWSYGEPAEMLNTGAEDGDGDFLGESSGAYIIRIPFGPRDKYQRKELLWPHIREFVDGALAHILNMSKTLSEQIGDGQPVWPYVIHGHYADAGDSAALLSGALNVPMVLTGHSLGRNKLEQLLKQGRQSKEDINSTYKIMRRIEAEELSLHAAELVITSTRQE

SEQ ID NO: 24668 - protein, 113 aa, Homo sapiens [sequence omitted]

SEQ ID NO: 24669 - protein, 138 aa, Ovis aries
MDKSELVQKAKLAEQAERYDDMAAAMKAVTEQGHELSNEEWRVISSIEQKTERNEKKQMGKEYREKIEAELQDIMKGDYFRYLSEVASGDNKQTTVSNSQQAYQEAFEISMQPTHPIRLGLALNFSWTSENQGDEGDA

SEQ ID NO: 24670 - protein, 162 aa, Ovis aries
MDKNELVQKAKLAEQAERYDDMAACMKSVTEQGAELSNEERNLLSVAYKNVVGARRSSWRVVSSIEQKTEGAEKMKGDYYRYLAEVAAGDDKKGIVDQSQQAYQEAFEISKKEMQPTHPIRLGLALNFSVFYYEILNSPEKAMQLLRDNLTLWTSDTQGDEA

SEQ ID NO: 24671 - protein, 422 aa, Mus musculus
MPGTSRHSGRDAGSALLSLHQEDQENVNPEKLAPAQQPRAQAVLKAGNVRGPAPQQKLKTRRVAPLKDLPINDEHVTAGPSWKAVSKQPAFTIHVDEAEETQKRPAELKETECEDALAFNAAVSLPAARKPLTPLDYPMDGSFESPHAMDMSIVLEDKPVNVNEVPDYQEDIHTYLREMEVKCKPKVGYMKRQPDITNSMRAILVDWLVEVGEEYKLQNETLHLAVNYIDRFLSSMSVLRGKLQLVGTAAMLLASKFEEIYPPEVAEFVYITDDTYSKKQVLRMEHLVLKVLAFDLAAPTVNQFLTQYFLHLQPANCKVESLAMFLGELSLIDADPYLKYLPSLIAGAAFHLALYTVTGQSWPESLAQQTGYTLESLKPCLVDLHQTYLKPPQHAQQSIREKYKHSKYHSVSLLNPPETLSV

SEQ ID NO: 24672 - protein, 246 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKFVYLKMKGDYYRYLAEVASGEKKNSVVEASEAAYKEGFEISKEQMQPTHPIRLGLALNFSVFYYEIQNAPEQACLLAKQAFDDAIAELDTLNEDSYKDSTLIMQLLRDNLTLWTSDLQDEEAGEGN

SEQ ID NO: 24673 - protein, 275 aa, Cucurbita pepo
MAGRSSPREEFVYLAKLAEQAERYEEMVEFMEKVSAAVDNEELTVEERNLLSVAYKNVIGARRASWRIISSIEQKEESRGNDDHVSIIRDYRSKIETELSNICGFRILNLLDSRLIPSAASGDSKVFYLKMKGDYHRYLAEFKTGAERKEAAESTLTAYKSAQDIANAELPPTHPIRLGLALNFSVFYYEILNSPDRACSLAKQAFDEAIAELDTLGEESYKDSTLIMQLLRDNLTLWTSDIRGSRDDIKEAAPKRDCTNSSEQIDLHVQDSTSP

SEQ ID NO: 24674 - protein, 409 aa, Caenorhabditis elegans
MRSALSLKPSNGNAAKSQAVNNKNVIKNAPLGGKLTRQIGTSNLLQQALPSKKIDESPIIKIDAKDSFKVFEDQEPEKENSSENVDATEKDSNVIPAEDNNMIHELERKMEEKSRAEKLKFKFMQTRDNSDITSRFSEPPSEFSVLCDDDDCDKVSVASSTFTTSVRATFSSFHFDENQRKKEFGKEEAVKKIQKKAAKEARDDSMFSSEEFFPDIIKYMLHRQTKNRASHECFDIQSQVNEEMRTILIDWFSDVVKEYNFQKETFHLAVSLVDRALSMFNIDKMRFQLVGTTSMMIAVKYEEIFPPEIEDFALITDNTYRVPDILLMERFLLGKFDFVVAMPTSSWFGTCFAKRMNFTKKMRNTVHYLLELSLIDVHFLRYRPSDIAAAACCFANLQADVESWPQKNG

SEQ ID NO: 24675 - protein, 292 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 24676 - protein, 1431 aa, Homo sapiens
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQVTCAASAQIPISRTKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNPVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTNNGAPKDFLPSPLHALLREWTTYPESTVGTLMSKLRELGRRDAADLLLKASSVFKINLDGNGQEAYASSCNSGTSYNSISSVVSR

SEQ ID NO: 24677 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 24678 - protein, 157 aa, Candida albicans
LLSLDGTPNKSKLGANAILGVSLAAANAAAAAQGIPLYKHIANISNAKKGKFVLPVPFQNVLNGGSHAGGALAFQEFMIAPTGVSTFSEALRIGSEVYHNLKSLTKKKYGQSAGKLGDEGGVAPDIKTPKEALDLIMDAIDKAGYKGKVGIAMDVAL

SEQ ID NO: 24679 - protein, 708 aa, Homo sapiens
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 24680 - protein, 280 aa, Drosophila melanogaster
MKFVILLCVLSALLLQIEASPLQRLSRSERAVSPQQTVNNEVAPAVRPASDDDDDDDDEDDDDEPDLGDLIDDDDDDDEEEDDDEDEEDDTPQGQAAPAATASDDDEEEDDDDDDYLDRLFDDILGDDEDEDDDDETPAATAQQSAVAAAPAQTLDEVAPAAASSVSAGISDGVDLPAESGNAAEVLAAGNAADESVSAAVAPAQNAAASSSNNEGIAGDDDEEADDDDDDDDDDIIGHDIIEARREARESKSKSETATKETKAKKSTSPSKKAKKDVKH

SEQ ID NO: 24681 - protein, 796 aa, Drosophila melanogaster
MRWELRYGWQIVTFRTNCATAAAVACHQLLCPVSLTSAVEIMPNSFPPEGRRRERRSGNLVLRAGCCCIGKYFLHNRCASSVKKECTLGEYSELIVPPTAICPAVLDRQRSVNQAHKATHFQITPPDELSCPLLVFVNPKSGGRQGDRILRKFQYMLNPRQVYDLSKGGPKEGLTLFKDLPRFRVICCGGDGTVGWVLEAMDSIELASQPAIGVIPLGTGNDLARCLRWGGGYEGENIPKLMDKFRRASTVMLDRWSIEVTNTPHSDDMRPKVTLHSNMQKVIELSQSVVVDKSLMERFEEIQRQSKQVATSMGTAASSTSIMMASKTETEMETMATMEFGSSTTTTNRTTTTKSISMSTFETQCLQHTLRTATSSSSSNTSSGSPCSGNQDAETEVDSHAAAAADVREKSVPRRSGETEKQSLETLLLLQHKLQMQQQQQQQQQQQQQGVTSLAVEEAATATPVGSNQSDNSSQRNKQNNILKQQITLSLDLSDHEDEPKDDGGGSGDGTKSNGNSIPATPAIPITPTTPNAASSVLQQQQQQHLQFEQQQKPIKVQSDKDCTVPYNIINNYFSVGVDAAICVKFHLEREKNPHKFNSRMKNKLWYFEYATSETFAASCKNLHESIEIVCDGVALDLANGPHLQGVALLNIPYTHGGSNLWGEHLSQKRIRKSAGPFDKSKKLRAGDKEFSATSFNSVDLSVAIQDFGDRLIEVIGLENCLHMGQVRTGLRASGRRLAQCSEVIIKTKKTFPMQIDGEPWMQMPCTIKVTHKNQVPMLMAPRSEKGRGFFNLLCS

SEQ ID NO: 24682 - protein, 280 aa, Phaseolus vulgaris
GEGTYGVVYKARDRVTNEAIALKKIRLEQEDEGVPSTAIREISLLKEMQHRNIVRLQDVVHSGKRLYLVFEYLDLDLKKHMDSSPEFAKDLRQVKMFLYQILCGIAYCHSHRVLHRDLKPQNLLIDRSTNSLKLADFGLARAFGIPVRTFTHEVVTLWYRAPEILLGSPRYSTPVDIWSVGCIFAEMVNQRPLFPGDSEIDELFKIFRILGTPNEDTWPGVTSLPDFKSAFPKWQPKDLKTVVPNLDPAGLDLLSRMLHLDPSKRITGRSALEHEYSERH

SEQ ID NO: 24683 - protein, 307 aa, Ascaris suum
MAEEKKSKKFVKDMKKFDAKKFFIDLATGGTAAAISKTAVAPIESVKILLQVQDAQKTIAAEKRYKGIVDVLVRVPSEQGLVALWSGNLANVISYFPTQALNFAFKDTFKDMFMKGIDKKTQFWKFFAGNLAAGGAAGAASMCFVYPLDFARTRLAADIGKGASREFKGLTDCIVKVFKSDGPIGLYSGFFVSVQGIIIYRAAYFGMFDTVKILFAADKKLNFFIAWAIAQVVTVSSGILSYPWDTVSSRMMMQSGRKDILYKNSADCAMKIISKEGFSALFKGALSTFPSAGGAVLAIYDEIQKYL

SEQ ID NO: 24684 - protein, 489 aa, Homo sapiens [sequence omitted]

SEQ ID NO: 24685 - protein, 277 aa, Entodinium caudatum
DKEELLNRCKLNDLIENYGEMFEYLKELSHIKIDLQPDELDLITRCTKCYIGHKRGQYRKILTLIDKDKIVDNQKNSALLEILRKKLSEEILLLCNSTIELSQNFLNNNVFPKKTQLFFTKIIADHYRYIYEINGKEDIKLKAKEYYEKGLQTIKTCKYNSTETAYLTFYLNYSVFLHDTMRNTEESIKVSKACLYEALKDTEDIVDNSQKDIVLLCQMLKDNISLWKTETNEDNDNDNNNSTNNGKNNIENNSLNNINIKESTENNINEIKTNSDK

SEQ ID NO: 24686 - protein, 140 aa, Glycine max; identical to SEQ ID NO: 1266

SEQ ID NO: 24687 - protein, 539 aa, Coprinopsis cinerea
MFKNLLSFALLAISVANAQIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGQLTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVVRRAEPTGFSAKFRREGL

SEQ ID NO: 24688 - protein, 517 aa, Coprinopsis cinerea
MLLLATALATSLLPFVLGAIGPSTNLVVANKVIAPDGFSRSAVLAGATQPTVQFPGPVIQGNKNSFFAINVIDALTDPTMLRTTSIHWHGMFQRGTAWADGPAGVTQCPISPGHSFLYKFQALNQAGTFWYHSHHESQYCDGLRGAMVVYDPVDPHRNLYDIDNEATIITLADWYHVPAPSAGLVPTPDSTLINGKGRYAGGPTVPLAVISVTRNRRYRFRLVSLSCDPNYVFSIDGHTMTVIEVDGVNVQPLVVDSIQIFAGQRYSFVLNANRPVGNYWVRANPNIGTTGFVGGVNSAILRYVGASNTDPTTTQTPFSNPLLETNLHPLTNPAAPGLPTPGGVDVAINLNTVFDFSSLTFSVNGATFHQPPVPVLLQIMSGAQTAQQLLPSGSVYVLPRNKVIELSMPGGSTGSPHPFHLHGHEFAVVRSAGSSTYNFANPVRRDVVSAGVAGDNVTIRFRTDNPGPWILHCHIDWHLVLGLAVVFAEDAPTVATMDPPPAWDQLCPIYDALPPNT

SEQ ID NO: 24689 - protein, 516 aa, Coprinopsis cinerea
MQLLAFVLAALPLARAAIGPVGNLVIANANVSPDGFVRSAVLAGATGTSLEHPGPVIVGQKGDTFHINVIDDLTDPTMLRTTSIHWHGFLQEGTAWADGPAGVTQCPIAPGHSFLYKFQAKNQAGTFWYHSHHMSQYCDGLRGVMVVYDPLDPHRHLYDVDNENTIITLADWYHDPAPSAGLVPTPWSTLINGKGRYPGGPVVPLAVIHVSRGKRYRFRLVSLSCDPNYVFSIDGHTMTVIEVDGVNHEPLVVDHIQIFAGQRYSFVLNANRPVNNYWVRANPNLGSVGFGGGINSAILRYVGAPAVDPTTSQLPFSNPLLETNLHPLVNPAAPGGPSPGDVDVAINLDILFDVSILKFTVNGATFDEPPVPVLLQILSGAHTASSLLPSGSVYTLPPNKVIELTIPGGGIGAPHPIHLHGHTFKVVRSAGSSTYNFVNPVERDVVNVGQAGDNVTIRFVTDNAGPWILHCHIDWHLVLGLSVVFAEDVPTIDSSVQPPAWHDLCPIYDALPPGTR

SEQ ID NO: 24690 - protein, 484 aa, Sphingomonas paucimobilis
AHFPQTPGFSGTLRPLRIEGDILDIEIEGEVPPQLNGTFHRVHPDAQFPPRFEDDQFFNGDGMVSLFRFHDGKIDFRQRYAQTDKWKVERKAGKSLFGAYRNPLTDDASVQGMIRGTANTNVMVHAGKLYAMKEDSPCLIMDPLTLETEGYTNFDGKLQSQTFCAHPKIDPVTGNLCAFAYGAKGLMTLDMAYIEISPTGKLLKEIPFQNPYYCMMHDFGVTEDYAVFAVMPLLSSWDRLEQRLPFFGFDTTLPCYLGILPRNGDARDLRWFKTGNCFVGHVMNAFNDGTKVHIDMPVSRNNSFPFFDVHGAPFDPVAGQGFLTRWTVDMASNGDSFEKTERLFDRPDEFPRIDERYATRAYRHGWMLILDTEKPYEAPGGAFYALTNTLGHIDLATGKSSSWWAGPRCAIQEPCFIPRSPDAPEGDGYVIALVDDHVANYSDLAIFDAQHVDQGPIARAKLPVRIRQGLHGNWADASRLAVAA

SEQ ID NO: 24691 - protein, 103 aa, Styela plicata
MSGRGKGGKGLGKGGAKRHRKVLRDNIQGITKPAIRRLARRGGVKRISGLIYEETRGVLKVFLENVIRDAVTYTEHAKRKTVTALDVVYALKRQGRTLYGFGG

SEQ ID NO: 24692 - protein, 260 aa, Pisum sativum
MAAAHTPREENVYMAKLAEQAERYEEMVEFMEKVSANADSEELTVEERNLLSVAYKNVIGARRASWRIISSIEQKEESRGNEDHVDVIRDYRSKIESELSNICDGILKLLDTRLIPSASSGDSKVFYLKMKGDYHRYLAEFKTGAERKEAAESTLAAYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKADEQQ

SEQ ID NO: 24693 - protein, 103 aa, Anabaena variabilis
MSVYVGNLSYDVTEDSLNPVFAEYGSVKRVQLPTDRETGRMRGFGFVEMGSDAEETAAIEALDGAEWMGRDLKVNKAKPKEDRGSFGGGNRGGYGGGGGRNRY

SEQ ID NO: 24694 - protein, 382 aa, Oryza sativa
MAEQANQPTVLQKFGGQFHLGSSFSEGVRARNICPSVSSYDRRFTTRSYMTQGLVNGGINVPMMSSSPIFANAPAEKGGKNFMIDFLMGGVSAAVSKTAAAPIERVKLLIQNQDEMIKAGRLSEPYKGIGDCFGRTIKDEGFASLWRGNTANVIRYFPTQALNFAFKDYFKRLFNFKKDKDGYWKWFGGNLASGGAAGASSLFFVYSLDYARTRLANDAKAAKGGGERQFNGLVDVYRKTLKSDGIAGLYRGFNISCVGIIVYRGLYFGMYDSLKPVVLYGSLQDNFFASFALGWLITNGAGLASYPIDTVRRRMMMTSGEAVKYKRYMDAFSQILKNEGAKSLFKGAGANILRAIAGAGVLSGYDQLQILFFGKKYGSGGA

SEQ ID NO: 24695 - protein, 199 aa, Homo sapiens
MKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKTSVVEASEAAYKEAFEISKEQMQPTHPIRLGLALNFSVFYYEIQNAPEQACLLAKQAFDDAIAELDTLNEDSYKDSTLIMQL

SEQ ID NO: 24696 - protein, 278 aa, Trichomonas vaginalis
MDLSAYHKDMKLGEGTYGSVFRATHIPTDQPVVLKLVRMDLEEDGIPPSSVREVCILKSLNHPNILHFREVICKDSKIIMVCEFMDMDLKNFLSKRRMNPDLLRSYAFQLLCGTYYLHRIGIVHRDIKPENILIDRNGLLKLGDFGTAAYCFHPIPYDIEEIKTPWYLAPEILINAPAHGTEIDIWSIGCVIAEMARGNLFMGDSQVDQLIKITEVLGIPSEEDYPDFYKYKINNMPCMKKEKPDFNSFFPGVDPELVDLISKMLQMNPEHRINAQTH

SEQ ID NO: 24697 - protein, 259 aa, Arabidopsis thaliana
MASGREELVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 24698 - protein, 271 aa, Streptomyces roseofulvus
MTTAAPHTRPGEAGTTRGPALVTGATRGIGLAVAEALVARGYPVVVCARDAEAVARTVKELAAGGARVEGVVADVTDAASVHELVATTVARFGPVEVLVNNAGRSGGGVTAELSESLWDDVIATNLKSVFLVTREVLTTGGMTGRGRGVVNIASTGGKQGVVFGAPYSASKHGVVGFTKALGLELARSGITVNAVCPGYVETPMAAGVRRHYADLWDVTEEDVLARFEAKIPLGRYTRPDEVAALVDYLVTDAAAAVTAQALNVCGGLGNY

SEQ ID NO: 24699 - protein, 174 aa, Lycopersicon esculentum
MAEATAVAAQPQPESTTPPPMAKSDDSKAIATLPPTKPDSSTKKSSKGSFDRDVALAHLEEEKRNSYIKAWEESEKSKVNNKAEKKLSSVGTWENTKKANIEAKLKKLEEQLEQKKAEYAEKIKNKVAAVHMEAEEKRAMVEARRGEELLKAEEIAAKYRATGQAPKKIGCLGC

SEQ ID NO: 24700 - protein, 198 aa, Sanguinaria canadensis
AGIMKKARELTVLCDAEVSLIMFSSTGKFSEYISPSATTKRIYDRYQQVSGTNLWNSHYESMQNHLNKQKEINNRLRREIRQRMGEDLDDLTFEELRGLEQNLDTSLKVVRDRKYHVITTQTDTTRKKIRSLTETHHNLLREFEGRDEDPHYALANQEEDYEAVLELANGGPNIFAFRLQPSQPNLHDGYSSNDLRLA

SEQ ID NO: 24701 - protein, 194 aa, Ranunculus bulbosus
AGIMKKAQELTVLCDAKVALLMISNNTHKISEYVSPGTSFKAIYDQYEKTSGVSLWDSEYERMQRNLKKVKEDNNKLRKEIRQRQGDDLDGLSFAELRGLEQNMHSSVERVRHRKEHVIRTQTDTTNKKIKSHEETQRTLLAEYDVMDKAGSQYSFVQQDEDYDPINIGSRIYAIQMQSHQDAQDYGSYSLRLA

SEQ ID NO: 24702 - protein, 193 aa, Ranunculus ficaria
AGIMKKAQELTVLCDAKVALLMFSSSGKVSEYVSPGTSFKSVYDQYQAINKMSLWDSEYEKMQGTLKKVKETNNNLRREIRQRQGDDLDGLSFMELRGLEQNLESSVDRVRHRKNHVIRTQTDTTNKKIKSHEETNRNFMSALEQMGKVEPQYAYVPQDEDYDANNMGSRIYAIHMQTHQNGEDYGSYGLSLA

SEQ ID NO: 24703 - protein, 214 aa, Sanguinaria canadensis
NGILKKAKEITVLCDAKVSLVIFSSTGKMAEYCSPCPLIEILDRYQKSSGKRLWDAKHEYLSAEVDRIKKENDNMQIELRHLKGEDLTSLHPKELIPIEKALEVGYASVRAKQMEIWKTLKKNGRLLEDEHKRLSYKYHQQHQMEIEGGARGEMEQNGGTAGGGSGGYNHQKAAAGAAGRPDYPPSHHQQQQQQMPFAFCVQAIQPNVHNNNNK

SEQ ID NO: 24704 - protein, 169 aa, Ranunculus ficaria
TGITKKAKEISILCAAEISLVIFNSNGKMDEFHSHSLINSLKRFHHKCPEKTRLWDPKHEYLHQEIERIKKENSSMKTQLKHLKGEDLNVLQPTELIPIEHALDNGITKLRAKLDNIPRIMEKNGRRIEEENKLLAFKLQQMNANSGRDEYPSSAQMMPFTFSVHPNLH

SEQ ID NO: 24705 - protein, 202 aa, Hyacinthus orientalis
MGRGKIEIKRIENSTNRQVTFSKRRNGIIKKAKEISVLCESEIAIVVFSSLSKMSEFCSPNTTFPKMLEKYQQHSGKKLWDAKHENLSAEIDRIKRENDNMQIELRHLKGEDLSSLNPRELIPIEEALQNGVTGARAKQMEFLKMMKLNGKLLEDENKKLAYLLHHQELAMDGSRHQRGTEYASEIPMALRVQPVQPNLQEA

SEQ ID NO: 24706 - protein, 202 aa, Hyacinthus orientalis
MGRGKIEIKRIENSTNRQVTFSKRLNGIIKKAKEISVLCESEIAIVIFSSLNKISDFCSPNTSLPKMLEKYQQHSGKKLWDAKHENLSAEIDRIKRENDNMQIELRRLKGDDLTSLNPRELIPIEEALQNGVTGACAKQMEFLKMMKLNGKLLEDENKKLAYFLHHQELAMDGNRHQRGTEYASEIPMALRVQPVQPNLQEA

SEQ ID NO: 24707 - protein, 303 aa, Homo sapiens
MVAPRPLRRVVLFYQGKLCSMAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 24708 - protein, 359 aa, Antirrhinum majus
MGRSPCCDKVSLKRGPWTPEEDQKLLSYIQEHGHGSWRALPSKAGLQRCGKSCRLRWSNYLRPDIKRGKFSLQEEQAIIQLHAFLGNRWSAIATHLPKRTDNEIKNYWNTHLKKRLTKMGIDPMTHKPKSHDVLGCGQPKVVANLSHMAQWESARLQAEARLVRESRLVSHHYHSQLLNRATAITHPTLPPCLDVLKVWHGAWTTRPGKDIITSAMFNGFFASNNGNLESPTSILKSSDNMLNASTSVGLLHENPFITDMSYVGKPSNVYEDWVKGIMDNSNELNKIIEPIDSTHYVAHDDDSIGFPGFMEGSTNLVTSTVRTNGPDDDNVVGVFEENDINYWRNVLNVVNSPMGSPVF

SEQ ID NO: 24709 - protein, 179 aa, Nicotiana tabacum
MECVMAHEKDLNLKATELRLGLPGTEDESIVSSSKNKKRGLPESAEDEDCESKKKTQIVGWPPVRSYRKNNIQPKKTETECGMYVKVSMDGAPYLRKIDLKMYKGYAELLKALENMFKLSIGEYSEREGYNGSEFAPAYEDKDGDLMLVGDVPWDMFLSSCKRLRIMKGSEARGLGCGV

SEQ ID NO: 24710 - protein, 240 aa, Nicotiana tabacum
MTSVMGAECDKIQLDYEAETELRLGLRSAINGNEGEMTSKNNGKRVFSETVDLKLNLSSKDSTVDNQVDNIKEKKNIAPTDPAKPPAKAQVVGWPPVRSFRKNVLTVQKNSTGNGESSGGGAAFVKVSVDGAPYLRKVDLKMYKSYQQLSDALGKMFSSFTIGNCGTHGFKDFMNESKLIDLLNGSDYVPTYEDKDGDWMLVGDVPWEMFVDSCKRLRIMKGSEAIGLAPRAVEKCKNRS

SEQ ID NO: 24711 - protein, 220 aa, Nicotiana tabacum
MERTATYVKDLNLEATELRLGLPGINEPEKQSSSASTSAKYSKKRTSSEMDNSSSGKENEQDSAPAPKAQVVGWPPVRSFRKNVLTVQKKSTGNGESSSGGAAFVKVSVDGAPYLRKVDLKMYKSYQQLSDALGKMFSSFTIGNCGNHGFKDFMNESKLIDLLNGSDYVPTYEDKDGDWMLVGDVPWEMFVDSCKRLRIMKGSEAIGLAPRAVEKCKNRS

SEQ ID NO: 24712 - protein, 368 aa, Prunus armeniaca
MATLVEPPDGIRQRGKHYYSMWQTLFEVDTKYVPIKPIGRGAYGIVCSSINRATNEKVAIKKINNVFENRIDALRTLRELKLLRHIRHENVIALKDVMMPIHRTSFKDVYFVYELMDTDLHQIIKSSQPLSSDHCKYFLFQLLRGLKYLHSANILHRDLKPGNLLINANCDLKICDFGLARTSGGTGQFMTEYVVTRWYRAPELLLCCDNYGTSIDVWSVGCIFAEILGRKPIFPGTECLNQLKLIINVLGSQHEPDLAFIDNPKARKYIKSLPYSRGTHFSRLYPQADPLAIDLLQRMLVFDPTKRISVTEALQHPYMSGLYDPRCNPPAQVPINLDIDENLAEPMIREMMWHEMLHYHPEAAFVNA

SEQ ID NO: 24713 - protein, 771 aa, Dictyostelium discoideum
MMNGLGRQDIDFNTIWKNIADQVYKILTGSQNVSAMFLYEDVYKLCIAQPQPYCEPLYENIKKFFEQHVDQILLIILDTKSDTISEYLKQWKLFFSGCELCNKVIFRYLNLNWINKKILDKKFGHPPDVYEIQILGLMIWKERLFFKIKDRVLKCVEILIQKDRDGELVQHQFISQFMESLIKLDSVDKDRTLYLIEYEASYLENTRQFYTRESVAFIASSGISSYMKKAETRIDEEEQRSQKYLNSSSHDKMRRLLHSILIEKHKELLQSECINYLKDEKLDEIYNMYKLLSRIEGGLAPVLETVQKYIQHVGIDAIKSIPDRNNPDPKIYVETLLKIYLQFSSIIKKSFNNDVSFITVLDLACHKIFNQNHITRNTTKSPELLAKYCDMLLKKGNKQHEEIELEEKLGQIIVLFKYVDDKDVFQKFYSKMLSRRLINGTSVSDDIEKFMITGLKQACGFEYTSKFQRMFNDITLSAETNEEFKNHLIKNSLSIGKIDFSILVLTSGSWSLHSQTSSFIVPQELTLCISAFQQYYSTQHQGRKLNWLHHLCKAEAKSFFAKKSYDFQVTNFQLGILLIFNTQESVSLEEITKFTNLNENELSRTLQSLIEAKILISKKKDQNSINNNNNNNNNNNNNGEGNNSLVDSANNMQPSSSSSSTQEYTVNSAYSNKRSKVKVSSSLQKETPLQNEETYKGIDEDRKLYLQASIVRIMKARKTMNHVSLIQEVIEHSRLRFQPNIPMIKKCIEQLIEKEYITRAEGESDRYLYAA

SEQ ID NO: 24714 - protein, 228 aa, Hyacinthus orientalis
MGRGKIEIKRIENTTSRQVTFCKRRNGLLKKAYELSVLCDAEVALIVFSTRGRLYEYSNSNSVKTTIERYKKACTDTTNTGTVSEANSQYYQQEATKLRQQITNLQNTNRTLMGESLSTMSLRELKQLEGRLERGINKIRTKKNELLSAEIEYMQKREAEMHNDNMYLRNKIAENERAQQQMNMLPSTATEYEGIPQFDSRNFLQVSLMEPNNHHYSRQQQQTALQLG

SEQ ID NO: 24715 - protein, 499 aa, Cicer arietinum
MEYNFLTYIIFLSLFLITTKLLFSKRKFKKLPPCPPSIPIIGNLHQVKQPIHHTFYNLSKKYGPIFTLKFGSQPVVVVSSASLVEECFTKNDIIFANRIHSAKTKYLGYNNTNMVSTSYGDLWRNLRRISSIEILSTHRLNSFSEIRKDETMRLIGKLAKKSHKDFTKVELRSLFGELTFNTIMRMVCGKRFYGEESDGTNAEEAKKFRDMMNEMQEFGLGSNLGDFVPLFKLFDFSGGHKKLKKVGEKMDALFQGLVDEHRNNKDKNLNTMIDHLLSLQESQPDYYSDQIIKGLIMALIVAGTETSSVTLEWAMSNLLNHPEILEKAKIELDNHIGQEHLIEEAEATKLQYLQNIISETLRLHPPVTMLLPHLSSHDCTIGGYDVPRNTMLMVNAWAIHRDPNLWADPMSFKPERFENGQGDIGGFIPFGMGRRACPGSGLALRTLGLTLGSLIQCFEWKRIGKEEVDMSEGSGTVVPKAIPLEAQCKARPIINKIFN

SEQ ID NO: 24716 - protein, 1116 aa, Homarus americanus
MTKYFDFVWRKEVDSRLQEGAVIDRWTEDKESYDYEPNCTFKVDEYGFFVFWKSDGREGNVAELSQVSDIRRGTLPRDSKLLDKLLNKFGQDVEDKMLAICSGLDYVSINYINIVCKTKDEADAWLEGLRNIFHNIRANNICPMMCLKKHWMRLGMMVDSGGKIPVKHIVRTFASGKTEKMVYSCLEEMGLPSGKGDSIEKDAFTFEKFYKLYHTICPRTDIDELYTSVTKGEHVSLAQLVNFMNEKQRDPSLNEILYPLYDEKRCMQIIKAHEPNEENIENKRFSKDGLLAYLMSDENDPVFLDRLDIYQDMDQPLSHYYINSSHNTYLSGRQFGGKSTAEMYRQTLLAGCRCVELDCWDGKGEDEEPIITHGKAMCTDILFKEAIIAIRDCAFVTSDYPVILSFENHCCKKQQYKLAKYCDEYFGDLLSKEALPDRPLVPGHHLPSPNQLKRKILIKNKRLKPEVEKQELELFWKGQLYLVDDDDAREDASQANPQPKEPKSNSCTTITTPVSQPSLEDDKPLTAEERAFLYYQYTGATTHVHPVLSSYVNYCQPVNFQGFDVAKEKNVHHNMSSFSETMGLGYLKTQAIEFVNYNKRQMSKIYPKGARVDSSNYMPHVFWNAGCQMVSLNFQTSDLPMQLNQGKFEYNGNCGYLLKPDFMRRTDKTFDPFAESPVDGVIAAQVSVSVIAGQFLSDKKVGTYVEVDMYGLPTDTIRKEFRTRYDSLEMALIPSIMKNLPPFLSCVCLTWLCCELVCFMKIEKYWAKEFCLWMVCMQAGYRHISLRTEGNFPMSLPMLFCNIELKIYVPDGLGDLMDALSDPRAFLSAQEKREEQMKAMGIEASDIDTKALKGGGGKAGGAKPAAGAKAGACGKPGACAGGKKKKKFVEYEPINLETLRSQKNFLKATKKQQKELESMRKKHMKERLSIQKAQCSAIEKLAKGKKDVMDDPKIKSLVSEQMKQWSEMMEKHRKEEWEMLKEHLKSQEDILKKLMEEEQAGQIKKMEAKHEQDMKDMKAQQAKAAMETAKDVNQDKTLKTKADRDRRLKEKNQNNTKRFIEERKISAMKQGKQKEKLKKVHDQQMTELTKDIQMAIQFYENTEAEYKMWNKMEFFC

SEQ ID NO: 24717 - protein, 321 aa, Avena sativa
MMTMDLMGRYGRADEQVAIQEAAAAGLRGMEHLILQLSRTGTGTGTSESSLAGASEPAAQGQQQQQQVDCREITDMTVSKFKKVISILNHRTGHARFRRGPVVAQSQGPSVSEPAPVRTASSSRPMTLDFSKSASVFGNKDAAYSVSAASSSFLSSVTGDGSVSNGRGGGSSLMLPPPPSASCGKPPLAAAAAGPKRKCHEHAHSENVAGASGGRCHCSKRRKSRVKRMTRVPAISSKAAEIPADDFSWRKYGQKPIKGSPYPRGYYKCSTVRGCPARKHVERDPSDPSMLIVTYEGDHRHTPGDQEAAAALTPLPELHKL

SEQ ID NO: 24718 - protein, 501 aa, Avena sativa
MAMTPPTSFPPASPSSYFNNMSTGFLDSPILLTPSLFPSPTTGSFPLEPLNWMGTAPESNDGLQLGSVKDGQQRQYSGFTFQTTAAPVPAAMPGTNTTASSFLQSSMPMAQQGHDSYTGEQQQPWSYQDAGSMDAMTTRPASFSTPYEAPDMVGNGGYNNAPVSSSGTTAGYGRVQSRRPSSDDGYNWRKYGQKQMKGSENPRSYYKCSFAGCSTKKKVEQAPDGQVTEIVYKGTHNHPKPQNPRRSSAPASSSYASPDASSDALSGTPENSSASYGDDETNGVSSALAGQFGGGGEEFADNEPDSKRWRTDSDAEGVPVGANRTVREPRVVVQTMSDIDILDDGYRWRKYGQKVVKGNPNPRSYYKCTTAGCPVRKHVERASQDLRAVVTTYEGKHNHDVPALRGSAAAAARYRAAPMQAASYLQGGGGGYSSLRPDGFGGGAPAQPADQSGFALSGFDYNNSSYSYSGMQQQNDAMYYDAARTKDEPRDDMFFEQSLMF

SEQ ID NO: 24719 - protein, 561 aa, Drosophila melanogaster
MRVWVAYSAAALLLLVHAGPESISGQEVPQSKTSSNTTTTDNSSSIHTVSDVFVNSPLGNVTPSISASGNASTTKRGNASTLVTDPPLIDSHAVEQEHNSSLSLFFVICVIMLGILLIHSMLQTGFQYLPESIVVVFLGAFIGLSLNVMSGQNGSWKREEVFSPMGFFLVLLPPIIFESGYNLHKGNFFQNIGSILVFAIFGTTISALVIGAGIYLLGLGEVAFRLSFSESFAFGSLISAVDPVATVAIFHALDVDPILNMLVFGESILNDAISIVLTASITQSANVNAEASTGEAMFSALKTFCAMFFASAGIGVIFALISALLLKHIDLRKHPSLEFAMMLMFTYAPYVLAEGIHLSGIMAILFCGIVMSHYTHFNLSTVTQITMQQTMRTLAFIAETCVFAYLGLAIFSFKHQVELSFVIWAIVLCLIGRACNIFPLAFLVNKFREHKINNKMQFIMWFSGLRGAISYALSLHLNLDSQEKRHVIITTTLIIVLFTTLVLGGSTMPLLKYLKPGKKRRARGSGRNAAEEGGRRNGSGREAFKIYFPIENSRMGPGNRL

SEQ ID NO: 24720 - protein, 257 aa, Streptomyces lavendulae
MSTVTDRATERLGQSGRVVVVSGASGQIGGACALELAALGATVVAGYHSGEQAIRKLREQVEGQGGTLVPVAADLSEPEGADALVAAAVERFGRVDGCVAAAGLRTRRLAMATDARSLEKLLRVNLAGSVGLAKACLKPMMRARYGRIVLFGSRAGTSGLPGHSAYAATKGALQPWAASVAGEVGKHGITVNVVAPGAIRAEVMDFSEAERDLVLQFIGAGRLGEPEEVAAAVSFLLSPSASYVNGNTLVVDGGARF

SEQ ID NO: 24721 - protein, 511 aa, Streptomyces lavendulae
MKAMDRVDRAVERFPMYIDGQAVQAHDGAVLRTFEPATRRHLADLPSGGAEDVRRAVSAARRAFDEGPWPRMAPGERAGLLRKAAQRLREEAEPLAELEARDNGSTLRKALGADVPGAAAAFEWSAWWAEHVPERQPEAPGSGSYVVWRPVGVVAAIVPWNLPLLLAAWRIAPAIAAGNTCVIKPASFASLSTLRLVELLHECGLPPGVVNVVTGPGGVAGEQLVRSPGVDLVAFTGSDETGAAVREGAAAAGTSARLDLGGKSPNIVLADADLDRAVTGVTWGAFLHNGQVCMAGTRAVVHADVHDDFLRLLSERVGRLRVGDPLDPATDLGPLVSRNQARTARRFTELGLSQGAELVCGGRAPAADELPPGLDAGAYFLPTVLASVGADDAVAQEEIFGPVLAVVRAGSDDDAVRIANGSRYRLSAGVWSADPARARAVAERLRADRVWINDYRLVDLELPGTAGPRSAVWDRLTNELDAYRHKHVVHGGGAGAGGVPAPPTPYALLGG

SEQ ID NO: 24722 - protein, 398 aa, Escherichia coli
MKQLTILGSTGSIGCSTLDVVRHNPEHFRVVALVAGKNVTRMVEQCLEFSPRYAVMDDEASAKLLKTMLQQQGSRTEVLSGQQAACDMAALEDVDQVMAAIVGAAGLLPTLAAIRAGKTILLANKESLVTCGRLFMDAVKQSKAQLLPVDSEHNAIFQSLPQPIQHNLGYADLEQNGVVSILLTGSGGPFRETPLRDLATMTPDQACRHPNWSMGRKISVDSATMMNKGLEYIEARWLFNASASQMEVLIHPQSVIHSMVRYQDGSVLAQLGEPDMVRQLPTPWAWPNRVNSGVKPLDFCKLSALTFAAPDYDRYPCLKLAMEAFEQGQAATTALNAANEITVAAFLAQQIRFTDIAALNLSVLEKMDMREPQCVDDVLSVDANAREVARKEVMRLAS

SEQ ID NO: 24723 - protein, 327 aa, Escherichia coli
MVLISLLNPETQNRSQNMSQNNPLRALLDKQDILLLDGAMATELEARGCNLADSLWSAKVLVENPELIREVHLDYYRAGAQCAITASYQATPAGFAARGLDEAQSKALIGKSVELARKAREAYLAENPQAGTLLVAGSVRPYGAYLTDGSEYRGDYHCTVEAFQAFHRPRVEALLVAGADLLACETLPNFSEIEALAELLTAYPRARAWFSFTLRDSEHLSDGTPLRDVVALLAGYPQVVALGINCIALENTTAALQHLHGLTVLPLVVYPNSGEHYDAVSKTWHHHGEHCAQLADYLPQWQAAGARLIGGCCRTTPADIAALKARS

SEQ ID NO: 24724 - protein, 177 aa, Citrus unshiu
MSSRERDPLIVGRVVGDVLDNFTRTIPMRITYSNKDVNNGRELKPSEVLNQPRAEIGGDDLRTFYTLVMVDPDAPSPSDPSLREYLHWLVTDIPATTGASFGQEIVNYESPRPTMGIHRFVFVLFRQLGRQTVYAPGWRQNFSTRDFAELYNLGPPVAAVYFNCQRESGSGGRPVRR

SEQ ID NO: 24725 - protein, 289 aa, Drosophila melanogaster
MTTKHIYSTTNLSDLQLKEQGNCLFAARKYDDAINCYSKAIIKNPTNATYFTNRALCNLKLKRWELCCQDSRRALDIDGNLLKGHFFLGQGLMEIDNFDEAIKHLQRAYDLSKEQKQNFGDDITLQLRLARKKRWNVMEEKRIQQEIELQSYLNGLIKGDMESRLANLKLNGNVHDEQLKDKQQEIEQECDDHIKELNNIFSKVDERRKKREVPDFLCGKISFEILTDPVITPSGITYERKDIEEHLQRVGHFDPVTRVKLTQDQLIPNFSMKEVVDSFIAENEWSLDY

SEQ ID NO: 24726 - protein, 303 aa, Homo sapiens [sequence omitted]

SEQ ID NO: 24727 - protein, 221 aa, Gossypium herbaceum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVALFGLGAVGLAAAEGARVCGASRIIAVDVNPRRFEEAKRFGITEFVNPKDYDKPVQEVIVEMTGGGVDRSV

SEQ ID NO: 24728 - protein, 205 aa, Gossypium herbaceum
HTCGEHVGLNVNGEPFVACHECNFPICKSCFEYDLKEGRKACLRCGSPYDENLLDDVEKATGDQSTMAAHLSKSQDVGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVICEIWFAF

SEQ ID NO: 24729 - protein, 205 aa, Gossypium raimondii
HTCGEHVGLNVNGEPFVACHECNFPICKSCFEYDLKEGRKACLRCGSPYDENLLDDVEKATGDQSTMAAHLNKSQDVGIHARHISSVSTLDSEMAEDNGNSIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVICEIWFAF

SEQ ID NO: 24730 - protein, 205 aa, Gossypium robinsonii
HTCGEHVGLNVNGEPFVACHECNFPICKSCFEYDLKEGRKACLRCGSPYDENLLDDVEKATGDQSTMAAHLSKSQDIGIHARHISSVSTLDSEMTEDNGNPIWKNRVESWKEKKNKKKQPATTKVEREAEIPPEQQMEDKPAPDASQPLSTIIPIPKSRLAPYRTVIIMRLIILGLFFHYRVTNPVDSAFGLWLTSVICEIWFAF

SEQ ID NO: 24731 - protein, 179 aa, Triticum aestivum; identical to SEQ ID NO: 4567

SEQ ID NO: 24732 - protein, 321 aa, Vibrio parahaemolyticus
MSISNTVSKVEEFEYDNASETTIDNELEKSSSTTEGKTAVREEFDASSKSLDATQLYLGEIGFSPLLTAEEEVLYARRALRGDEAARKRMIESNLRLVVKISRRYSNRGLALLDLIEEGNLGLIRAVEKFDPERGFRFSTYATWWIRQTIERALMNQTRTIRLPIHVVKELNIYLRTARELSQKLDHEPTAEEIAAQLDIPVEDVSKMLRLNERISSVDTPIGGDGEKALLDIIPDANNSDPEVSTQDDDIKSSLIHWLEELNPKQKEVLARRFGLLGYEPSTLEEVGREIGLTRERVRRLREILIKQGLNMENLFNVEDD

SEQ ID NO: 24733 - protein, 377 aa, Pisum sativum
MSVADVKERHIAATETVNNLRERLSRDRLSLLDTDIAGYARSQGRAPVTFGPTDILCCRTLQGHTGKVYSLDWTSEKNRIVSASQDGRLIVWNALTSQKTHAIKLPCAWVMTCAFSPTGQSVACGGLDSVCSIFNLNSPLDRDGNLNVSRMLSGHKGYVSSCQYVPGEDTHLITGSGDQTCVLWDITTGLRTSVFLGEFQSGHTADVLSISINGSNSKLFVSGSCDATARLWDTRVASRAVRTFHGHEGDVNSVKFFPDGNRFGTGSEDGTCRLFDIRTGHQLQVYNQQHQDNEMAHVTSIAFSISGRLLIAGYTNGDCYVWDTLLAKVVLNLGSLQNSHEGRITCLGMSADGSALCTGSWDTNLKIWAFGGHRKVI

SEQ ID NO: 24734 - protein, 484 aa, Acinetobacter sp. ADP1
MTLLDASIWNKKLFNGGWFESGQPYGVVEVATGEQLGQTGSASPTDVAQAAKEAQTAQRQWWALDYLERQAVFEKAVQIATEHQDELVNWLIRESGSLALKAQFEVKVSIQMLKNCIAFPQLDQGNILPSRNGKLSLAKRLPLGVVGVISPFNFPLYLALRAVGPALAFGNAVVLKPDERTAVCSGYAIARIFELAGLPKGLLHVLPGGADTGEALTLDPHIASIQFTGSTQVGRIIGANAGKTLKKVSLELGGKNSLIILDDADLDLAAENIAWGAFLHSGQICMTSGKILIHEKIYDALKARVIEKVKRFVVGNPLEQNVTIGPLINEKQSKRVEALVQAAVEHGATLEIGGKANGPFFEPSVLSQVQADNPIFSEEIFGPVAVLIPFASDEQAIELANMGDYGLSAGIISSNVGRAMQLGAQLNVGLLHINDQTVNDETINPFGGFGASGNATRIGGPANPDEFTQWQWMTIQAEAPHYPF

SEQ ID NO: 24735 - protein, 371 aa, Acinetobacter sp. ADP1
MTKFTEITAAVTECKGADFELKQLKIREPQNDEVLVKIVATGMCHTDLIVRDQYYPVPLPAVLGHEGSGIIEAIGPNVKDLAVGDHVVLSYGFCGSCEQCSSGQPAYCQDFFGRNFSGGDPDGHSAVCSHDHHKIHDHFFAQSSFATYAISRENNAVKVSKDVPLELLGPLGCGIQTGAGAAINALKVAPASSFVTWGAGAVGLSALLAAKVCGATTIIAVDIVESRLALAKELGATHVINSKTQDPVEAIKEITGGGVKFALESTGRPEILKQGIDALGILGSIAVVGAPPLGTTAAFDVNDLLLGGKSIIGVVEGSGVPKKFIPALVSLYQQGKFPFDKLVKFYDFKDINQAAIDSHKGITLKPILKIG

SEQ ID NO: 24736 - protein, 502 aa, Dictyostelium discoideum
MMKPDLNSPLPQSPQLQSFGSRSSDLATEDLFLKKLEAISQTAPNETVKNEFLNKEIPSINKLFTRFLKNRKKVIDWDKINPPPADMVLNYKDLPAITEQRTSELASKLAVLKLNGGLGTTMGCTGPKSVIEVRSEKTFLDLSVQQIKEMNERYNIKVPLVLMNSFNTHQETGKIIQKYKYSDVKIHSFNQSRFPRILKDNLMPVPDKLFGSDSEWYPPGHGDVFFALQNSGLLETLINEGKEYLFISNVDNLGAVVDFNILEAMDKNKVEYIMEVTNKTRADVKGGTLIQYEGKAKLLEIAQVPSSKVEEFKSIKKFKIFNTNNIWVNLKAMDRILKQNLLDDMDIIINPKVADGKNIIQLEIAAGAAIEFFNNARGVNVPRSRFLPVKSTSDLFIVQSNLYSLEKGVLVMNKNRPFTTVPLVKLGDNFKKVSDYQARIKGIPDILELDQLTVSGDITFGPNMVLKGTVIIVANHGSRIDIPEGSEFENKVVSGNLHCGAL

SEQ ID NO: 24737 - protein, 432 aa, Homo sapiens
  unsure (1)..(432): unsure at all Xaa locations
XSDKLPYKVADIGLAAWGRKALDIAENEXPGLXRXRERYSASKPLKGARIAGCLHXTVETAVLIETLVTLGAEVQWSSCNIFSTQNHAAAAIAKAGIPVYAWKGETDEEYLWCIEQTLYFKDGPLNXILDDGGDLTNLIHTKYPQLLPGIRGISEETTTGVHNLYKXXANGILKVPAINVNDSVTKSKFDNLYGCRESLIDGIKRATDVXIAGKVAVVAGYGDVGKGCAQALRGFGARVIITEIDPINALQAAXEGYEVTTXDEACQEGNIFVTTTGCIDIILGRHFEQXKDDAIVCNIGHFDVEIDVKWLNENAVEKVNIKPQVDRYRLKNGRRIILLAEGRLVNLGCAXGHPSFVXSNSFTNQVXAQIELWTHPDKYPVGVHFLPKKLDEAVAEAHLGKLNVKLTKLTEKQAQYLGXSCDGPFKPDHYRY

SEQ ID NO: 24738 - protein, 102 aa, Kluyveromyces lactis
GSRRASVGSMARPAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 24739 - protein, 284 aa, Pseudomonas aeruginosa
MTTSLQPVHALVPGANLEAYVHSVNSIPLLSPEQERELAERLFYQQDLEAARQMVLAHLRFVVHIAKSYSGYGLAQADLIQEGNVGLMKAVKRFNPEMGVRLVSFAVHWIKAEIHEFILRNWRIVKVATTKAQRKLFFNLRSQKKRLAWLNNEEVHRVAESLGVEPREVREMESRLTGQDMAFDPAADADDESAYQSPAHYLEDHRYDPARQLEDADWSDSSSANLHEALEGLDERSRDILQQRWLSEEKATLHDLAEKYNVSAERIRQLEKNAMSKLKGRILG

SEQ ID NO: 24740 - protein, 423 aa, Rattus norvegicus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKSCSPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSDAAVSSKATPSQSSSINDISSMSTEHTLASDTDSSLDASTGPLEGCR

SEQ ID NO: 24741 - protein, 350 aa, Sus scrofa
GNAAAAKKGSEQESVKEFLAKAKEDFLKKWENPAQNTAHLDQFERIKTLGTGSFGRVMLVKHKETGNHFAMKILDKQKVVKLKQIEHTLNEKRILQAVNFPFLVKLEYSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 24742 - protein, 374 aa, Homo sapiens
STAGKVIKCKAAVLWEVKKPFSIEDVEVAPPKAYEVRIKMVAVGICRTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 24743 - protein, 374 aa, Homo sapiens
STAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 24744 - protein, 374 aa, Homo sapiens
STAGKVIKCKAAVLWEVKKPFSIEDVEVAPPKAYEVRIKMVAVGICGTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 24745 - protein, 301 aa, Paramecium tetraurelia
MDLAQSEERYQKLEKIGEGTYGLVYKARDNQTGDIVALKKIRMDHEDEGVPSTAIREISLLKEVQHPNIVPLKDVVYDESRLYLIFDFVDLDLKKYMESVPQLDRMQVKKFINQMIQALNYCHQNRVIHRDLKPQNILVDIKQQNTQIADFGLARAFGLPLKTYTHEVITLWYRAPEILLGQRQYSTPVDIWSLGCIFAEMAQKRPLFCGDSEIDQLFKIFKIMGTPKESTWPGVSTLPDFKSTFPRWPTPTNPAATLGKDITNLCPLGLDLLSKMITYDPYARITAEEALKHAYFDELNN

SEQ ID NO: 24746 - protein, 153 aa, Medicago sativa
TTRKITLKSSDGETFEVDEAVALESQTIKHMIEDDCADSGIPLPNVTSKILAKVIEYCKKHVDAAAAEDKPNEDELKSWDSEFVKVDQATLFDLILAANYLNIKSLLDLTCQTVADMIKGKTPEEIRKTFNIKNDFSPEEEEEVRRENQWAFE

SEQ ID NO: 24747 - protein, 521 aa, Nicotiana tabacum
MESGSMEMKVQQPYLAVPVLPPRWKIVMVASIAAGVQFGWALQLSLLTPYLQLLGIPHRYASIIWLCGPISGMIVQPAVGYLSDNLSSTFGRRRPFIAAGSSLVAVAVIFIGFAADIGHAFGDPLDTKTKPLGIITFIVGFWYLDVANNMLQGPCRAFLADLSGGKACRIRTGQSCYAFFMAVGSILGNAAGSYSHLYTIFPFTKTEACGVQCANLKSCFLISVVLLLTLTTLALTAVDEKVLPQKDHFINSEYLGSSGKKGGLLFFGEMFEALKHLPRSVWILLMVTAVNWIAWFPFTLYGTDWMGKEVYGGRVRDGNLYNKGVHAGVFGLLLSSVVLCLMSLGVECVGKWLGGAKRLWGIVNFILAICLAMTVFVTKMADKSRRYDGDGELLPPDQGVKISALLLNAVTGIPLAVLYSIPFAMASIYSSNVGAGQGLSQGVINLAIVVPQTLVSISGRPFDALFGGGNLPAFVAGAVAAAVSGILALTLLPSPTEPCQTYPHFRRCFPMTKYWTSQNKF

SEQ ID NO: 24748 - protein, 517 aa, Emericella nidulans
MKDIPAADDIQLAALGHKAELKRNFSMLSMLGLAFAILNSWTALSTSLNLSLPSGGCTSVVWGLVTAGVCNICTAASLAEFLSAWPTAGGQYHWVAAISWKRQMPMLSWVTGWANVAGWLALTATGGLLSSTLIGGIIGLVYPLFEFQRWHQFLIYIAINIIAFAINAFMNVGLPLVTKSAFIWSLTGFVVISITILSCASPDYNSGKFVFGEFINTTGWPDGVAWLLGLLQGGFGLTGFDGVAHMIEEIPNPTVLGPRIMIGCVCIGITTGLIFLIVLLFVAGDINLVIESAATPLLQIFHDATNSNAGSICLLMFPLVCTVFAATTIMTTSSRMVYAFARDGGLPASPFFSRVHPKLQVPLNGLYLTMFCVIVFGCIFLGSSSAFNAITSSSVVMLDVAYGIPIAINCLRGRQMIPERAFVLPQALGWMVNLIALAYISLTTVLFLFPPELPVTGSNMNYCVAAFGIVLIISAFQWIVDGRKHFTGPRVDAEVLAAVESYSGPNIDGAAEIREQK

SEQ ID NO: 24749 - protein, 361 aa, Emericella nidulans
MGCMSSKQLEAGDDKEAIQRNARIEKSLKNDKKVMDRTIKILLLGAGESGKSTIIKQMRIIHSGGFPEDERRQTRAVIYSNIVVAFKVLLDIMRTENIDFEQEGTRVSDTEFVDNLEPDVGVEEAFSDLRVRDAMNEMWKDGGVQKAVSKGHEFALHDNLNYFFHSLDRLFESGWLPDNQDMLQARLRTTGITETLFELGQMNFRMMDVGGQRSERKKWIHCFEGVQCLLFMVALSGYDLCLVEDQNANQMHEAMMLFESLVNGEWFKRKPIILFLNKIDLFKDKLAISPISKHFPDYSDSNTDFDAAAKYFADRFRGINRIPEREIYIHYTNATDTTLLKATMDSVQDMIIQKNLHTLIL

SEQ ID NO: 24750 - protein, 502 aa, Arabidopsis thaliana
MVLSHAVSESDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLEEAETAVGVGTVGSSEAIMLAGLAFKRKWQNKRKAEGKPVDKPNIVTGANVQVCWEKFARYFEVELKEVKLSEGYYVMDPQQAVDMVDENTICVADILGSTLNGEFEDVKLLNDLLVEKNKETGWDTPIHVDAASGGFIAPFLYPELEWDFRLPLVKSINVSGHKYGLVYAGIGWVIWRNKEDLPEELIFHINYLGADQPTFTLNFSKGSSQVIAQYYQLIRLGHEGYRNVMENCRENMIVLREGLEKTERFNIVSKDEGVPLVAFSLKDSSCHTEFEISDMLRRYGWIVPAYTMPPNAQHITVLRVVIREDFSRTLAERLVIDIEKVMRELDELPSRVIHKISLGQEKSESNSDNLMVTVKKSDIDKQRDIITGWKKFVADRKKTSGIC

SEQ ID NO: 24751 - protein, 718 aa, Dictyostelium discoideum
MSPYQQNPIGSLGGLYGSGGIEKSSQIIGNYRLDKTLGIGSFGKVKLAKHIRTGVKVAIKILNKTKIKNLKMDEKIRREIQNMKLFRHPHFINLYEVIETTTDIPMVMEYVPGGELLDYIVRNGNLLEDESRRPFQQMISGVGYCHHHMVVHRDLKPENLLLDPINKCIKIADFGLSNMMQDGDFLKTSCGSPNYAAPEVISGKLYAGPEVDVWSCGVILYAFLCAKLPFDDESIPMLFKKIREGVFSIPDFVSPSCADLIKKMLVVDPVKRITIHEIRNHPWFQVKLPKYLSSPHTFLSKSIQTINNSILNEMVQVYAPIDRERIIGGLQKSGEVNDLIVSYHLLVDSKRGSYDDEVYSPNLVSPITTPIMSSAPQRPIMFTTTTGFNPTNSNSISNNNNNNNNNNNNTTNNNNNTTNNNNSIINNNNINNNNINNNNNNNNNNINNNNIINNNNNNNNNNNNNNNNNNNNNNNNNNSSISGGTEVFSISPNLNNSYNSNSSGNSNGSNSNNNSNNNTNNDNNNNNNNNNNNNNNNNNNNNNNNNNNNCIDSVNNSLNNENDVNNSNINNNNNNNSDDGSNNNSYEGGGDVLLLSDLNGNNQLGGNDNGNVVNLNNNFQLLNSLDLNSDIQTQPHRKWYLGAISQLPPHEIMGEIYRALKKVGFEWKLTGPYQLRCRMVNGKPIKLVLQLFRVAENRYLLDIKKIEGEIFIFLIFVV

SEQ ID NO: 24752 - protein, 490 aa, Brassica napus
MVGALESDQSFAMAEKFDILSEGFDPTAVAPEPLPLPVTNGTGADQEEDNLKKTKVVTNGGGEREMVLGRNVHTTSLAVTEPESNDEFTGDKEAYMASVLARYRKTLVERTKYHLGYPYNLDFDYGALGQLQHFSINNLGDPFIESNYGVHSRPFEVGVLDWFARLWEIERDDYWGYITNCGTEGNLHGILVGREVFPDGILYASSESHYSVFKAARMYRMECEKVDTLISGEIDCDDFRRKLLANKDKPAILNVNIGTTVKGAVDDLDLVIKTLEECGFSHDRFYIHCDGALFGLMMPFVKRAPKVTFNKPIGSVSVSGHKFVGCPMPCGVQITRMKHIKVLSNNVEYLASRDATIMGSRNGHAPLFLWYTLNRKGYKGFQKEVQKCLRNAHYLKDRLREAGISAMLNELSSTVVFERPKEEEFVRRWQLACQGDIAHVVVMPSVTVEKLDHFLKDLVEHRLVWYEDGSQPPCLVKDVGINNCICPAHK

SEQ ID NO: 24753 - protein, 343 aa, Atropa belladonna
MATLVSNWSTNNVSESFVAPLEKRAENDVPLGNDVPIIDLQQDHLVVVQQITKACQDFGLFQVINHGLPEKLMAETMDVCKEFFALPAEEKEKLQPKGEPAKFELPLEQKAKLYVEGEQLSDEAFLYWKDTLAHGCHPLDEELVNSWPEKPATYREVVAKYSVEVRKLTMRILDYICEGLGLKLGYFDNELSQIQMMLTNYYPPCPDPSSTLGSGGHYDGNLITLLQQNLPGLQQLIEDAKWIAVEPIPTAFVVNLGLTLKVITNEKFEGSIHRVVTNPTRDRVSIATLIGPDYSCTIEPAKELLSQDNPPLYKPYSYAEFGEIYLSDKSDYDAGVKPYKINA

SEQ ID NO: 24754 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 24755 - protein, 454 aa, Caenorhabditis elegans
MALVSHTHPAAVGSTTCYEKNQQKQQQVQQIPTQPQVAHVSSNAILAAAQPFYPPPVQDSQPDRPIGYGAFGVVWSVTDPRSGKRVALKKMPNVFQNLASCKRVFREIKMLSSFRHDNVLSLLDILQPANPSFFQELYVLTELMQSDLHKIIVSPQALTPDHVKVFVYQILRGLKYLHTANILHRDIKPGNLLVNSNCILKICDFGLARTWDQRDRLNMTHEVVTQYYRAPELLMGARRYTGAVDIWSVGCIFAELLQRKILFQAAGPIEQLQMIIDLLGTPSQEAMKYACEGAKNHVLRAGLRAPDTQRLYKIASPDDKNHEAVDLLQKLLHFDPDKRISVEEALQHRYLEEGRLRFHSCMCSCCYTKPNMPSRLFAQDLDPRHESPFDPKWEKDMSRLSMFELREKMYQFVMDRPALYGVALCINPQSAAYKNFASSSVAQASELPPSPQAW

SEQ ID NO: 24756 - protein, 375 aa, Homo sapiens
MSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 24757 - protein, 533 aa, Streptomyces griseus subsp. griseus
MTHVHSTATRPGTAAGGDPSRAPVSTRVVVDAAGGDGPAAGALSDALTALGLAPEAPDTEAPDTGRADSGDPAPAAYCALLLGEEAYGAGRSAGLDRSRVRAAALAIAAAGRGRLVLVTDATGETHAGTDPDRYARLAADRAWWQHLVTEVAGRGVTGNTVVTGYSPGLGHRLSAEAEAGLLRCLVQRRPTTAADVAATVAFLVSEGCSYLVGETLPVDGGAGLGQIPSLPAGPPTTAPAPRRGAPREQPPPEPVSGQDLLGHKVLVAGASSGIGRAAALHLAGRGADVILAARRTQALEEVAAEIEARGRQAWTLRCDLSDAEDAASLGERAWKAADGVTALLYAAGHLGFSAVGGDPASAARTFAVNLHSFVAVTEYLAARWRDERMPGAVVGVSSVSSTLSPVAGLEYYGASKAAMAQYIRCLAVSVGRHGIRANCVAPGIIETPMGDAAGPDHRRGWISRIPAGRVGDPHEVAAVLGYLLSGSASRVTGAVLRADGGFGLGDVAPLRPGYPERAFPAPALPERAEGENR

SEQ ID NO: 24758 - protein, 184 aa, Entamoeba histolytica
EGILTCRGGKTSHAAVVARGMGKPCVSGAEGIKVDVAKKIAKIGSLEVHEGDILTIDGSTGCVYKGEVPLEEPQVGSGYFGTILKWANEIKKIGVFANADLPSAAKKALEFGAEGIGLCRTERMFNAVERLPIVVKMILSNTLEERKKYLNELMPLQKQDFIGLLKTMNGLPVTVRLLDPPLHE

SEQ ID NO: 24759 - protein, 350 aa, Oryza sativa (indica cultivar-group); identical to SEQ ID NO: 3604

SEQ ID NO: 24760 - protein, 365 aa, Ipomoea batatas
MVGGGDFLAVQTHGGQYVQYDIFGNLFEVTSKYAPPITPIGRGAYGIVCSALNAETNEMVAIKKIADAFDNYMDAKRTLREIKLLRHLEHENVIAIKDVIPPPLRREFNDVYIATELMDTDLHQIIRSNQGLSEEHCQYFLYQILRGLKYIHSANVIHRDLKPSNLLLNSNCDLKICDFGLARTNLDNEFMTEYVVTRWYRAPELLLNSSDYTAAIDVWSVGCIFMELMNRKPLFQGKDHVHQMRLITELLGTPTDSDLGSIQNENARRYIRQLPLRPRQQLANGFPHVHPLAIDLMDKMLTFNPSKRITVEEALAHPYLAQLHDKSDEPICPVPFTDFEKQAYGEEQIKDMIYQEALAMNPGYA

SEQ ID NO: 24761 - protein, 296 aa, Myxine glutinosa
MGFVKVVKNRAYFRRYQVKFKRRREGKTDYYARKRLVIQDKNKYNTPKYRLIVRITNKDIICQLAYAKIEGDVIVCASYSHELPKYGIPVGLTNYAAAYCSGLLVARRVLRKFGIDRVYEGQPEVTGDEFNVESVERGPGAFTCYLDTGLARTTTGNKVFGVLKGAVDGGLSIPHSTRRFPGYDSESKEFNPDIHRQHIFGTNISNYMKQLLEDDEDLYKKQFSRYIKHAITPDMLESMYENAHARIRKNPIRKKKPKWTGKCKRWNRAKLSLAQRNDRVAQKKASYLRAKQQQAT

SEQ ID NO: 24762 - protein, 1108 aa, Saccharomyces cerevisiae
MLVLTLLVCVFSSIISCSIPLSSRTSRRQIVEDEVASTKKLNFNYGVDKNINSPIPAPRTTEGLPNMKLSSYPTPNLLNTADNRRANKKGRRAANSISVPYLENRSLNELSLSDILIAADVEGGLHAVDRRNGHIIWSIEPENFQPLIEIQEPSRLETYETLIIEPFGDGNIYYFNAHQGLQKLPLSIRQLVSTSPLHLKTNIVVNDSGKIVEDEKVYTGSMRTIMYTINMLNGEIISAFGPGSKNGYFGSQSVDCSPEEKIKLQECENMIVIGKTIFELGIHSYDGASYNVTYSTWQQNVLDVPLALQNTFSKDGMCIAPFRDKSLLASDLDFRIARWVSPTFPGIIVGLFDVFNDLRTNENILVPHPFNPGDHESISSNKVYLDQTSNLSWFALSSQNFPSLVESAPISRYASSDRWRVSSIFEDETLFKNAIMGVHQIYNNEYDHLYENYEKTNSLDTTHKYPPLMIDSSVDTTDLHQNNEMNSLKEYMSPEDLEAYRKKIHEQISRELDEKNQNSLLLKFGSLVYRIIETGVFLLLFLIFCAILQRFKILPPLYVLLSKIGFMPEKEIPIVESKSLNCPSSSENVTKPFDMKSGKQVVFEGAVNDGSLKSEKDNDDADEDDEKSLDLTTEKKKRKRGSRGGKKGRKSRIANIPNFEQSLKNLVVSEKILGYGSSGTVVFQGSFQGRPVAVKRMLIDFCDIALMEIKLLTESDDHPNVIRYYCSETTDRFLYIALELCNLNLQDLVESKNVSDENLKLQKEYNPISLLRQIASGVAHLHSLKIIHRDLKPQNILVSTSSRFTADQQTGAENLRILISDFGLCKKLDSGQSSFRTNLNNPSGTSGWRAPELLEESNNLQCQVETEHSSSRHTVVSSDSFYDPFTKRRLTRSIDIFSMGCVFYYILSKGKHPFGDKYSRESNIIRGIFSLDEMKCLHDRSLIAEATDLISQMIDHDPLKRPTAMKVLRHPLFWPKSKKLEFLLKVSDRLEIENRDPPSALLMKFDAGSDFVIPSGDWTVKFDKTFMDNLERYRKYHSSKLMDLLRALRNKYHHFMDLPEDIAELMGPVPDGFYDYFTKRFPNLLIGVYMIVKENLSDDQILREFLYS

SEQ ID NO: 24763 - protein, 367 aa, Pseudomonas sp. M1
MKITAAVTRANSNGFSIENLELDEPRDDEVLVRIVGVGICHTDLVAAAGVLPIQPPAVFGHEGAGVVIKTGSKVTGVQSGDHVALSFHSCGECPRCRVDDPSYCHSFGLLNFTGIRQGGSNLHDATGAAVAGNFFGQSSFASHCVANQRNVVKVSKDIPLELVGPLGCGIQTGFGGVARALACEADSSILILGGGAVGLSAVMAAVIRGCQQIILTEPHAARRALALELGATAVIDQISEDVEQLFKGFLPAGVNYAFDTSGIGAALETAYRCLAPRATFGLVGVPQDWEQKLPGTLAEMVQSGIIFKGIIEGDSDPQQSIPELIALYQAGRLPIDKLVTTFPLAQINKAIAAQHAGTCVKHVLLAG

SEQ ID NO: 24764 - protein, 594 aa, Arabidopsis thaliana
SKPSSSVKPNPYAPKDAVLQNDDSTPAHPGKSPVRSSPAVKASPFFPFYTPSPARHRRNKSRDGGGGESKSVTSTPLRQLARAFHPPSPARHIRDVLRRRKEKKEAALPAARQQKEEEEREEVGLDKRFGFSKELQSRIELGEEIGRGHFGYTCSAKFKKGELKDQEVAVKVIPKSKMTSAISIEDVRREVKILRALSGHQNLVQFYDAFEDNANVYIVMELCGGGELLDRILARGGKYSEDDAKAVLIQILNVVAFCHLQGVVHRDLKPENFLYTSKEENSMLKVIDFGLSDFVRPDERLNDIVGSAYYVAPEVLHRSYTTEADVWSIGVIAYILLCGSRPFWARTESGIFRAVLKADPSFDEPPWPSLSFEAKDFVKRLLYKDPRKRMTASQALMHPWIAGYKKIDIPFDILIFKQIKAYLRSSSLRKAALMALSKTLTTDELLYLKAQFAHLAPNKNGLITLDSIRLALATNATEAMKESRIPDFLALLNGLQYKGMDFEEFCAASISVHQHESLDCWEQSIRHAYELFEMNGNRVIVIEELASELGVGSSIPVHTILNDWIRHTDGKLSFLGFVKLLHGVSTRQSLAKTR

SEQ ID NO: 24765 - protein, 407 aa, Thermotoga maritima
MAKKEKVTMNEEQQVLQEQHQEQTQEQTQEQKETLPPQIERRIKKLISLGKKKGYITYEDIDKAFPPDFEGFDTNLIERIHEELEKHGINIVENEPEEEEISASSDEQELEELLEKESPEIHDSSNVRDSIKMYLKEIGKIPLLTPAQERELARRAQMGDKKAKEKLITSNLRLVVSIAKRYMGRGLSFQDLIQEGNIGLLKAVEKFDWRKGYKFSTYATWWIRQAITRAIADQARTIRIPVHMVETINKLNRLRREYYQKHGEEPSIEELAKMMGKPPEKIKEILEAAKETISLESPIGEDEDSSIEDFVADDSIASPKKEAMRMLMREELEKVLKTLSPREAMVLRMRYGLLDGKPKTLEEVGQYFNVTRERIRQIEVKALRKLRHPSRSKYLKSLLSLMDENEG

SEQ ID NO: 24766 - protein, 244 aa, Liquidambar styraciflua
LATTEFPNQSSEGSSSQKKMGRGKIEIKRIENTTNRQVTFCKRRNGLLKKAYELSVLCDAEIALIVFSSRGRLYEYANNSVKSTIERYKKASDTSNPGSVSETNAQFYQQESSKLRRQIRDIQNLNRHIMGEALSSLTFRELKNLEGRLEKGISRIRSKKNELLFAEIEYMQKREIELQNANMYLRAKIAENERNQQQTELMPGSVYETMPSSQPYDRSFLVANLLEPPNHHYSRQDQTPLQLV

SEQ ID NO: 24767 - protein, 281 aa, Arabidopsis thaliana
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWTKCFASIDEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 24768 - protein, 219 aa, Prunus armeniaca
MEKTECSEAENFGSVTTSLEPQATAKRKKAKSKNQRRFSDEQIRLLESIFEADSKLEPRRKVQVARELGLQPRQVAIWFQNRRARWKSKQIEQDFRTLRADYDNLASRFESLKEEKQSLLMQMQKLNELVGKPSQGLEGNIMVDGSRLQEELEPRGVIQSHKNNTSNDVGCHGDEIHELLSMAHVDASSLSPQDWHRFEPSILFDPSRFTSSHWLNFWT

SEQ ID NO: 24769 - protein, 370 aa, Prunus armeniaca
TNEVPSIANYDRKSEVKTFDDTKEGVKGLVDAGITKVPRIFHLPVDQYPINNTCDSEPTKTQLRIPVIDLEGLEYDNSPTKRKETVAKVGEASETWGFFQIANHGIPVDVLEEIKNGVRGFFEQDTEVKKKYYTRDRFRPVIYNSNFDLYSAPATNWRDTFLCNMAPNPPKPEDLPQVCRDILVEYSKQVMKLGKLLFELLSEALGLKPSHLNDMDCSLGLQILGHYYPPCPQPELTLGTSKHADNDFITVLLQDHIGGLQVLHQNTWIDVLPVPGALVVNIGDLLQLISNDRFRSVEHRVLANRACPRVSVACFFSTGFLALPRIYGPIKELLSEDNLPKYRETTVKDYNAHHYNKGLDGTCALTHFKL

SEQ ID NO: 24770 - protein, 342 aa, Homo sapiens
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 24771 - protein, 280 aa, Homo sapiens
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGYSTRL

SEQ ID NO: 24772 - protein, 529 aa, Homo sapiens
MDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 24773 - protein, 303 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTGSPLTQEQFIPNLAMKEVIDAFISENGWVEDY

SEQ ID NO: 24774 - protein, 372 aa, Homo sapiens
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSVDKVMSHSGDSHEESQTATLLCLVFGGMNTEGEIYDDCIVTVVD

SEQ ID NO: 24775 - protein, 297 aa, Mus musculus
MEDYIKIEKIGEGTYGVVYKGRHRVTGQIVAMKKIRLESEEEGVPSTAIREISLLKELRHPNIVSLQDVLMQDSRLYLIFEFLSMDLKKYLDSIPPGQFMDSSLVKSYLHQILQGIVFCHSRRVLHRDLKPQNLLIDDKGTIKLADFGLARAFGIPIRVYTHEVLTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLVYDPTKRISGKMALKHPYFDDLDNQIKKM

SEQ ID NO: 24776 - protein, 233 aa, Oryza sativa (indica cultivar-group); identical to SEQ ID NO: 3688

SEQ ID NO: 24777 - protein, 238 aa, Oryza sativa (indica cultivar-group)
ENSTNRQVTFAKRRNGLLKKAYELSVLCDAEVALIVFSNRGKLYEFCSTQSMTKTLEKYQKCSYAGPETAVQNRESEQLKASRNEYLKLKARVENLQRTQRNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEPMNSACMNTYMPPWLP

SEQ ID NO: 24778 - protein, 180 aa, Triticum aestivum; identical to SEQ ID NO: 5047

SEQ ID NO: 24779 - protein, 404 aa, Emericella nidulans
MASQVQPGQKPKVQPCRYKTGKTLGAGLYSVVKECVHIDTGQYYAAKVINKRLMVGREHMVRNEIAILKQVSTGHQNILTLVDYFETMNNLYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVDIWAIGLITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDPKPEHVNGSEVVEDRTTPRERENEDAMEIDSRSNARGQTEQQIREQERKVKETVAGLWSRTAPRSER

SEQ ID NO: 24780 - protein, 407 aa, Welwitschia mirabilis
MDAESFNPALGFYKWEQRNAASSAAALAAALGFNREQIRQLDFIVPAMNLNLNLNRKDLKSLEDLFKNYGVRYLTLAKMSEMGFTASTLINMTEEEIDELMKTLVEIYHVDLLIGERYGIKSAVRAEKKRLQESLDLQRLELLSEAEKKRLLQEDSTAFPMIMASEGTSKELRGSYPESASTDQVDVGTCKETAIVVQQNSHVQLCGSAMAGMGSDSDEQRTNTNTNTITNKKKRKKRSSTESSGEERPREHPFIVTEPGELARGKKNGLDYLFDLYEQCSRFLLEVQRMAKEKGEKCPNKVTNQVFRHAKHNGAVYINKPKMRHYVHCYALHCLNNEQSNQLRRMYKARGENVGVWRQACYYPLVMMAKDNNWDIDGVFNRHEKLKIWYVPTKLRQLCHLEKSKLC

SEQ ID NO: 24781 - protein, 270 aa, Oryzias latipes
MAKKVLIVYAHQSSSSFNSAAKTTAVEVLTTLGCSVEVSDLYAMNFKATATAEDIKGDLKDAENFSYLDESKLAWEEGRLMDDITKEQSKVIEADFIIFQFPMYWFSVPAIMKGWIDRVLTNGFAFTQEKRYSQGIFKEKRAMLSFTTGSLESMFSATGINGDMNVTLWPLQNGILHYCGFQVLAPQIFWAPFSATPEARSCMLEGWRARLQGLLEEQPLSFISLDCFDKKGFQLKSDVQEKHAAKDFGLAVGIHMGKPLPPHNQMKAGS

SEQ ID NO: 24782 - protein, 719 aa, Lycopersicon esculentum
MALCAYAFPGILNRTGVVSDSSKATPLFSGWIHGTDLQFLFQHKLTHEVKKRSRVVQASLSESGEYYTQRPPTPILDTVNYPIHMKNLSLKELKQLADELRSDTIFNVSKTGGHLGSSLGVVELTVALHYVFNAPQDRILWDVGHQSYPHKILTGRRDKMSTLRQTDGLAGFTKRSESEYDCFGTGHSSTTISAGLGMAVGRDLKGRNNNVIAVIGDGAMTAGQAYEAMNNAGYLDSDMIVILNDNRQVSLPTATLDGPVAPVGALSSALSRLQSNRPLRELREVAKGVTKQIGGPMHELAAKVDEYARGMISGSGSTLFEELGLYYIGPVDGHNIDDLIAILKEVRSTKTTGPVLIHVVTEKGRGYPYAERAADKYHGVAKFDPATGKQFKASAKTQSYTTYFAEALIAEAEADKDIVAIHAAMGGGTGMNLFHRRFPTRCFDVGIAEQHAVTFAAGLACEGIKPFCAIYSSFMQRAYDQVVHDVDLQKLPVRFAMDRAGLVGADGPTHCGAFDVTYMACLPNMVVMAPSDEAELFHMVATAAAIDDRPSCFRYPRGNGIGVELPAGNKGIPLEVGKGRILIEGERVALLGYGSAVQNCLDAAIVLESRGLQVTVADARFCKPLDHALIRSLAKSHEVLITVEEGSIGGFGSHVVQFMALDGLLDGKLKWRPIVLPDRYIDHGSPVDQLAEAGLTPSHIAATVFNILGQTREALEVMT

SEQ ID NO: 24783 - protein, 241 aa, Nicotiana sylvestris
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLTDLQRKEHALNEANRTLKQRLMEGSQLNLQWQQNAQDMGYGRQTTQTQGDGFFHPLECEPTLQIGYQNDPITVGGAGPSVNNYMAGWLP

SEQ ID NO: 24784 - protein, 242 aa, Nicotiana tabacum
MGRGKVQLRRIENKINRQVTFSKRRGGLAKKAHEISVLCDAEVALIVFSHKGKIFEYSSDSCMEQILERYERYSYAERRLLSSNSESSVQENWSLEYAKLKAKIDLLQRNHKHYMGEDLDSLNLKDLQNLEQQLDTSLKLIRSRKNQLMHESISMLQKKEKAIQEENNMLSKKIKEKDKTVGKQAEWHQQNQVPNSASFLLQPHPCLNIGGNYQEEAEEARRNELDLNLDSLYPCHMGCFAT

SEQ ID NO: 24785 - protein, 245 aa, Nicotiana sylvestris
MGRGRVQLKRIENKINRQVTFSKRASGLLKKAHEISVLCDAEVGLIVFSTKGKLFEYSTDSCMERILERYERYSYAERQLTATDDETPGSWTLEHAKLKARLEVLQRNQRHYAGEDLDSLSMKELQNLEHQLDSALKHIRSRKNQLMHESISELQKKDKALQEQNNNLSKQVKEREKELAQQTQWEQQSHDHLNSSSFVLTQPLSSLHLGEAYPTAGDNGEVEGSSRQQQQNTVMPPWMLRHLNG

SEQ ID NO: 24786 - protein, 242 aa, Nicotiana sylvestris
MGRGKVQLRRIENKINRQVTFSKRRGGLVKKALEISVLCDAEVALIVFSHKGKIFEYSSDSCMEQILERYERYSYTERRLLASNSESSVQENWSLEYAKLKAKIDLQQRNHKHYMGEDLDSLSLKDLQNLEQQLDTSLKLIRSRKNQLMHESISMLQKKEKAIQEENNMLSKKIKEKDNTVGQQVEWHQQNQVPTSASFLLQPHPCLNIGGNYQEEREERRRNELDLNLDSLYPCHMGCFAT

SEQ ID NO: 24787 - protein, 1419 aa, Plasmodium falciparum
MNGIFEGIEKRVVIKLKESFFKGNRNVNSFLDIPKELWEEKLKYIGCSIVSEISEDKNERRGERCRVYLLSESSLYIFDDSLFIKTCGKTRVLFFIPFVVDLLIYHMDNVGIIEKNCVYDETFIENEKFHNIAEFIKEHFLYCFFTHMNYRNKTKDGYFEQEYPHKSLEDEKKFFEFFFKNVQMYNTHLPMEKMHYIFFYSSDDVHMTDIASTFKFCSEIHLFGINKYNEKNQFHDAYLNNKSLNLFTRVHEDNLKLYDSSDADKEVTTHIYSTRGTYEDTGMVNCVDVIYKNESTLLNRNNIENIPSIENKESNNNSRCCHNNNYSGSCHNIVSVVPSERNNDHVHHRHYEDTLNRSNISAEDNNRNAQPEKEKDEDVRRDDEENKVLIKMIDTNLYECINYNKESFLYNEFYFTPCGYSCNVSEKNNYFCVHYSPEDSVSYVSVEVSSNLSCDRFLDFIHKQLNFYNGKYMFMINYVFCEESNNMSKMVPDDDNNNYSSGKSCVYYQDLNKKEKEEYYRLNKKLRNDLFINSKQFYELHTFTERTVGFMRVQYFVYKLRDVVKCVEKETLLARSSSCLFMFNNIKRNDVHDDYVTKSSNGGVIKQLTERDVDDMYEYALNFCKQNKIVVVDTNTFFFDASKRKENLIKLEKVQTNEKDEYEEKDEVYRRGNNELSSLDHLDSKNNLIHMYYEKNKCDIINKDDENSTIATNNNDNNNDSSSYDKSITISRSSSCNNSHLSYSSFDNNHGNEKMKDYISVDENNNNNNNNKNNNVLLTLQRNSDDENGKDKDNEKNDVSLENNMEKNYKEEIWNYYTKNKVEVKTLEKVLNENIDTSVVCINLQKILAQYVRFKKNLPHVTPFYSVKSNNDEVVIKFLYGLNCNFDCASIGEISKVIKLLPNLSRDRIIFANTIKSINSLIYARKENINLCTFDNLDELKKIYKYHPKCSLILRINVDFKNYKSYMSSKYGANEYEWEEMLLYAKKHNLNIVGVSFHVGSNTKNLFDFCLAIKLCRDVFDMSSNMGFNFYIINLGGGYPEELEYDNAKKHDKIHYCTLSLQEIKKDIQKFLNEETFLKTKYGYYSFEKISLAINMSIDHYFSHMKDNLRVICEPGSNMVAASSTLAVKIIGKRRPTFQGIMLKDLKDHYDPLNFAPQENKKQDETKINHNNDNNDNNDNNDNNINNNNNNQKGGQGNIMNDLIITSTNDSTSKKNDHSSSQVIQNVSCTIRDKEGDNIKINTHTINNPNINGKENTVDGDNINIAHKNIGNNFSSSNSKLGNITNIKKKVVNINDNRYNYFSYYVSDSIYGCFSGIIFDEYNRCPIYVIKNKNNPNQNFMNFNLYLANVFGQSCDGLDMINSITYLPECYINDWLLYEYAGAYTFVSSSNFNGFKKCKKVYIFPESKPSLKGQPNKHW

SEQ ID NO: 24788 - protein, 404 aa, Blastocladiella emersonii
APAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 24789 - protein, 394 aa, Vibrio parahaemolyticus
MLSNQTIEIVKATAPLIAETGPKLTAHFYDRMFTHNPELKDIFNMSNQRNGDQREALFNAICAYAANIENLPALLGAVEKIAHKHTSFLITKDQYQIVGKHLIATIDELFNPGQEVLGAWAEAYGVLANVFIQREEQIYQANASQEGGWRGLREFELVGKQLESEHICSFVFKPTDGSKVTKYKPGQYLGIYINSDKFENQEIRQYSLSSSVQENTYRISVKREQGGKVSNYLHDELNIGDKVKLAAPAGDFFMDVDTNTPVVLISAGVGLTPTLSMLESLTEHHAPVTWVHATENSKHHAFKEHVNQLVTAKENMNALIWYNQPTAEDKIGEDFHFTGFVNLHEIEAALKQDNVQVYFCGPVGFMQHVAKQLQELGVPQEQFHYECFGPHKVV

SEQ ID NO: 24790 - protein, 806 aa, Mus musculus
MAEPLKEEDGEDGSGEPPGRVKAEPVHTAASVVAKNLALLKARSFDVTFDVGDEYEIIETIGNGAYGVVSSARRRLTGQQVAIKKIPNAFDVVTNAKRTLRELKILKHFKHDNIIAIKDILKPTVPYGEFRSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVVSEPVCPDVEMPSPWRPSGDCAMESPPPALPPCSDPAPDTVDLTLQPAPPASELAPPKREGAISDNTKAALKAALLKSLRSRLRDGPSAPLEAPEPRKPVTAQERQREREEKRRRRQERAKEREKRRQERERKERGAGTLGGPSTDPLAGLVLSDNDRSLLERWTRMARPPAPAPAPAPRPAPQPSSAQPTSTPTGPVSQSTGPLQPAGCIPGPASQPVCPPPGPVPQPAGPIAAPLQTAPSTSLLASQSLVPPSGLPGSGAPEVLPYFPSGPPPPDPGLTPQPSTSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLSDLPDLQEP

SEQ ID NO: 24791 - protein, 737 aa, Mus musculus
MCGLLSRGGQQVAIKKIPNAFDVVTNAKRTLRELKILKHFKHDNIIAIKDILKPTVPYGEFRSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVVSEPVCPDVEMPSPWRPSGDCAMESPPPALPPCSDPAPDTVDLTLQPAPPASELAPPKREGAISDNTKAALKAALLKSLRSRLRDGPSAPLEAPEPRKPVTAQERQREREEKRRRRQERAKEREKRRQERERKERGAGTLGGPSTDPLAGLVLSDNDRSLLERWTRMARPPAPAPAPAPRPAPQPSSAQPTSTPTGPVSQSTGPLQPAGCIPGPASQPVCPPPGPVPQPAGPIAAPLQTAPSTSLLASQSLVPPSGLPGSGAPEVLPYFPSGPPPPDPGLTPQPSTSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLSDLPDLQEP

SEQ ID NO: 24792 - protein, 667 aa, Mus musculus
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVVSEPVCPDVEMPSPWRPSGDCAMESPPPALPPCSDPAPDTVDLTLQPAPPASELAPPKREGAISDNTKAALKAALLKSLRSRLRDGPSAPLEAPEPRKPVTAQERQREREEKRRRRQERAKEREKRRQERERKERGAGTLGGPSTDPLAGLVLSDNDRSLLERWTRMARPPAPAPAPAPRPAPQPSSAQPTSTPTGPVSQSTGPLQPAGCIPGPASQPVCPPPGPVPQPAGPIAAPLQTAPSTSLLASQSLVPPSGLPGSGAPEVLPYFPSGPPPPDPGLTPQPSTSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLSDLPDLQEP

SEQ ID NO: 24793 - protein, 519 aa, Petunia x hybrida
MWDLNDSPDQRREINIDESEEGCSSHIELEPDDEKGKRVGSFSTSSSSAIAIDEISEEEDGEKGKKKRSSPSKLFGFSMVGPGDLEQPITRQFFPVDEAEAETGVVTNGSLNFPRAHWVGVKFYQNEPLGITGVVDVTQQQQQQQQPMKKSRRGPRSRSSQYRGVTFYRRTGRWESHIWDCGKQVYLGGFDTAHAAARAYDRAAIKFRGVEADINFNLEDYEGDLKQMTNLTKEEFVHVLRRQSTGFPRGSSKYRGVTLHKCGRWEARMGQFLGKKYVYLGLFDTEVEAARAYDKAAIKCNGKDAVTNFDPSIYENELNSTESTDSGADHNLDLSLGGSSSKKNNREFGDNRGQNPSSMQFDVDWRHNGLRPEKQTAPVDMDARRRDNGYNESETLQLLSKTHLHSPVSLKHNNSHQLQRFGQYMRPGESHMIQMFPPQFGSSNYQIQFPSGSNGGRIGATNVGDLSLSSSNASSQWQSNLPPQIFAAAAASSGFSQQIVRPQNWSSENGFHHFLMRPS

SEQ ID NO: 24794 - protein, 457 aa, Petunia x hybrida
MFDLNLCFEDEEELQFDNHNNSTETSNNSSSIINNIETTTTSSTCDDHEYISYSNNEYNNNSFVDFLKTDNNDQFLDSKELFPLSNGGEMAAPVNVYGNYGGTMEQRIIIPVQQQQQQQQQQVKKSRRGPRSKSSQYRGVTFYRRTGRWESHIWDCGKQVYLGGFDTAHAAARAYDRAAIKFRGLDADINFNVSDYQDDLKQMTNFTKEEFVHILRRQSTGFSRGSSQYRGVTLHKCGRWESRMGQFLGKKYIYLGLFDSEIEAARAYYKAAIKCNGREAVTNFELSTYEGELSTEADNGGASHNLDLNLGIASSSIADDQHDNTCLIGNSEFQCASIGLPEYRGAMNSPCTTMGSKMPHGRHLLWNGVNTSVFPTFKGTAIGKGMEVDSAPNWTWQDQNLYGGSSSVPLFSTAASSGFANSTTADVHQHYFSTGPLPYHHSPSLANMNFAQYYCRS

SEQ ID NO: 24795 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPTEHNWPGISQFPEYKATAPRYATQDLRQILPQIDATGIDLLQRLLQLRPELRISAHDALQHPWFHDILQYQHCQQAAG

SEQ ID NO: 24796 - protein, 443 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVRQACKRGGKETKQIEEDGLVDVDGEKSKLAEDLSKIRMVESLDASASKELVDCAEEDRSDVTDCVQIVDIDSGVQDPQFCSLYAASIYDSINVAELEQRPSTSYMVQLQRDIDPTMRGILIDWLVEVSEEYKLVSDTLYLTVNLIDRFMSHNYIEKRKLQLLGVTCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNKTLQHYTRYETSALKNAVLAMEDLQLNTSGSTLIAIRTKYNQQKFKRVATLTSPERVNTLFSR

SEQ ID NO: 24797 - protein, 768 aa, Anguilla anguilla
MRSCARGRWISLLLMLIFLMETALTPFEKSSRNATNSSDTEEPAGVNNHTKRSFPVLRFNYEHVRIPFEISLWILLASLMKLGFHLLPGLSSVVPESCLLIVVGLLVGGLIKASGEELPVLDSESSSVPAAANHPERRLLPAHPPVRREHRHHPDLRRGGDPLERAVPGGHADAVAQLKASRLGGVDLLACMIFSAIVSAVDPVAVLAVFEEININELLHVLVFGESLLNDAVTVVLYHLFEEYVGVTSFSALDVVLAVLCFLVVSLGGVLVGATYGILAALTSRFTTNLRVIEPLLVFVYSYMAYLSAEVFHLSGIMSLIACGVVMRPYVEANMSHKSYTTIKYFLKMWSSVSETLIFIFLGVSTVAGPHDWNWTFVTVSVILSLVSRVLGVVGLTYIINKFRIAKLTPTDQFILAYGGLRGAIAFSLGFLLKPQHFPMRNMFLTSIITIVFFTVFVQGMTIQPLVELLAVKRKREGKGSINEEIHTMFMDHLLAGIDSVCGHYGHHLWKDKLSRFNRRYIQPCLVAEEGSREPQLLAFYNKMEMKQAIELVQSGGEARPLRTVDSSASIQSIQSQEPARDQRLPKVSVDQQAEILKILRRKLQKAEQKFYSNRRPTLWATPSRTTSRTSCGRGGGQSWAADECLPVGIAESAGLSLQNPQQTTEATPGQQVQTHELGRPGRPGDSLAPWSSFSPVSPKSPPHLGDAKAKDHISLRTNTVCCVRKVYDVGSQSPAGLQVAERRSCPSTFKTQMFYKIMSRKWRASFS

SEQ ID NO: 24798 - protein, 779 aa, Platichthys flesus
MAALALRAPRSSSSSGGRSAARLAGLLACVLLLAAGASASRDEGSGESNGTRRDPGRVESGTRRDLHPRSNLTAHKKAFPVLSFNYEHVRKPFEISLWILLALLMKLGFHIIPRVSNVVPESCLLIVVGLLVGGLIKAIGEKAPVLHYELFFFYLLPPIILDAGYFLPIRPFMENLGTILVFAVVGTLWNAFFIGGMMYAVCQIAGAQLGGVDLLSCLLFRTIISAVDPVAVLAVFKEIHINDLLHILLFGESLLNNAVTVVLYHLFKEFSQAGTVTVGDALLGIVCFFVVLSLGSIMVGAIYGLLGAFTSRFTSHTRVIEPLFVFLYSYMAYLSAEVFRLSGIMSLIPCGVTMRPYVEANISHKSHTTIKYFLKMWSSVNETLIFIFLGVSTVAGPHAWNWTFVILTVILCLVSTVLGVIGLTYIINKFRIVKLTKKDQFIVAYGGLRGAIAFSLGFLLTNNKMKNMFLTAIITVIFFTVFVQGMTIRPLVELLAVKKKKESKRSINEEIHTQFLDHLLTGIEEVCGHYGHHHWKDKLNRFNKSYVKKWLIAGERSTEPQLISFYNKMEMKQAMMLVESGSSAKLPSIVSSVSMQNIQQKGPTRGRAIPSISKSREAEIRKILRANLQKTRQRLRSYSRHDLLIDPFKDNLSEVRFRKQRVEMERRMSHYLTVPANRQETTPVRKVCFEPEHQVYTYDTEGESPRGRAAQTHPSPPDTIGLVNEATPRPNQSSALRDRDETELRAKAPDDQEEQLKLSRCLSDPGPNKDEEEDGSFVS

SEQ ID NO: 24799 - protein, 698 aa, Cyprinus carpio
MNVLLLLGCCCGLVCAGQNRSDPRDQRLFPVLSINYDYVQMPFEVSLWILLASLMKLGFHLLPVLSGVVPESCLLIVVGLLVGGLIRMMGKNPPVLDSQLFFLCLLPPIILDAGYFLPIWPFTENAGTILTFAVLGTLWNVFFMGAVLYGACRLEAGRLASVDLLSCLLFGSIVSAVDPVAVLAVFEEIHINELLHILVFGESLLNDAVTVVLYHLFEEFAHAGEVTVGDVFLGVVCFFVVALGGVMVGGVYGLLAAFTSRFTSHTRVIEPLFVFLYSYMAYLSAEVFHLSGIMALIACGVVMRPYVEANISHKSYTTIKYFLKMWSSVSETLIFIFLGVSTVAGPHAWNWTFVSITIVLCLLSKVLGVVGLTYIINKYRMVKLSGKDQFILAYGGLRGAIAFSLAFLLSRDDFPMKDMFLTAIITVIFFTVFVQGMTIRPLVELLAVKKKKKTKCSINEEIHTQFLEHLLAGIEGVCGHYGHHHWRHKLDRFNKRYIRRCLIGGERSQEPQLVSFYNKMELKQALMLLESNSSANLSTGDTAAAPRQRSRKTLNISKEREDEIRKILRANLQKTRQRLRSYSRHTLMPDAEDEDWSETRLRKQRLQMERRMSHFLTVPAHRGSPPARRARVESDSPALAARPSIFFSLADERWESRGRKPSVKFALDVEEQKLPRCVSDPGADQLLEEEEENIRHRH

SEQ ID NO: 24800 - protein, 264 aa, Streptomyces venezuelae
MSQQEKQEKRVALVTGATSGIGLAVARLLASQNHRVFLGARNAENVAATVKQLQDEGLEVDGTTLDVRSGEDVKAFVQAAVDRFGTVELLVNNAGRSGAGVTADIADELWNDVIDTNLNCVFRLTREALTTGGMREKSRGRIINMASTAGKQGVVLGAPYSASKHGVVGFTKALGNELAPTGITVNAVCPGYVETPMAQRVRQGYAAAYETSEDAILEKFQSKIPLGRYSTPEEVAGLVGYLASDTAASITSQALNVCGGLGNF

SEQ ID NO: 24801 - protein, 230 aa, Cucumis sativus
MEKKKMGFEETELRLGLPGNNNIGSSELGEVAARKRGFAETVSSETISKVDLKLNLSSKETVGVGDDDLVADSNPSNKDKAVLTADPAKPPAKAQVVGWPPVRSFRKNNMLAFVKVSMDGAPYLRKVDLKMYKSYKQLSDALAAMFGSFTTIGNCGSQEMKDFMNESKLMDLLSGSDYVPTYEDKDGDWMLVGDVPWEMFVESCKRLRIMKGKEAIGLAPRAMEKCKNRS

SEQ ID NO: 24802 - protein, 305 aa, Hydra magnipapillata
RIIHGKDYSEESLLEFKPIIYSNVLKGMKVLADARRKLDIPWGDPNSELYGEYILNIDHQTSTFDTAFFLEHVEAIRHLWNDTGIQTAFKRRNEFQLGDSTSYFLDSLDRVGRKDFMPSKQDMLHSRKATKGIQEYEFDLKGVPFVMVDVGGQRSQRTKWFQCFDNVTSILFMVSSSAYDQVIMEDRRTNCLIESCMIFETIVNNKCFTKVSIILFLNKTDLLEQKIRNRHNSIKDFFPQFQGDPYNLSDVQNFILQMFDSRRRERSKALFHHFTTAIDTENIKFVFHAVKDTILQDNLKSLMLQ

SEQ ID NO: 24803 - protein, 305 aa, Hydra magnipapillata
RIIHGQGYTEDDRRGYTNLVFLNIYQAMQALTRAMRNLKISYSNPANEENARLILDVDLSEDKSRTTITLSPQYASAIESLWKDSGIQEVYDRRREYQLSDSAKYYLSDLKRICAPNFVPTMQDVLRARAPTTGIIEYPFDLDTIIFRMVDVGGQRSERRKWIHCFENVTSIMFLVALSEYDQVLFESQSENRMDESKALFKTIITYPWFLQSSIILFLNKTDLLEEKIQKSDLQTYFPEYDGAKGDAKAAKEFILKMFVDLNPDTDKIIYSHFTCATDTENIRFVFAAVRDTILQLNLKEYNLV

SEQ ID NO: 24804 - protein, 301 aa, Hydra magnipapillata
KIIHESGYTSDECFQYKPVVYSNTIQSMLAIIRALGTLNIEFSNPDRQEDARQLFSLASGVEDGSFTPELIAIMKRLWRDEGVQQCFQRSREYQLNDSAGFYLSDLDRIGAPDYVPTQQDVLRTRVKTTGIVETHFVFKELHFKMFDVGGQRSERKKWIHCFEGVTAIIFCVALSGYDLLLAEDEETNRMHESMKLFDSICNNKWFMDTSIILFLNKKDLFAEKIKKSPLTTCFPEYMGANTYDEAGSYIQLQFENLNSRKGEKEIYTHFTCATDTNNIQFVFDAVTDVIIKNNLKDCGLF

SEQ ID NO: 24805 - protein, 305 aa, Ephydatia fluviatilis
RIIHGSGYNETDRANFKATVYRNVVVAIQAIVAAMRDLQIPYASDAVKEAAAEVESIAVEEVQMIDAGAKSAIERLWRDSGVQQCFLRRREYQISDSAKYYLDDLNRLCTQDYIPTMQDVLRVRVPTTGINEYLFTIDTRVFRMVDVGGQRSERRKWIHCFENVASVMFLVALSEYDQLLQETGEDVKVNRMEESLALFKTTTGLQWFTNSSLILFLNKKDLFEEKITTSSPLSDYFPDYKGPPKDHIQARDFILRKFTSSNPSREKDIYPHFTCATDTDNIKFVFETVRDHILDGIIGGIFPGL

SEQ ID NO: 24806 - protein, 301 aa, Ephydatia fluviatilis
RIIHGQGYSDADRADFRSLVFRNVFTAVNALTEAMTSLKIPFQNASNKESGAVYGRKKDEEVTMLSESDRDKLKAFWLDRGVQSCFERRNEFQISDSAKYYLDALDRICTSNYLPTVDDVLRIRIATTGIVEYTFPMRKDVVFRMVDVGGQRSERRKWIHCFEDVKAIIFLTAINEYDQVLVEDDTVNRLKESLALFETILRYPWFEKSSIVLFMNKEDIFKEKIMKSDLARYFPSYQGPKQNNEQAREFLKNEFLAVNPNPERIISPHFTCATDTENISRVFETVRLHVLEENLKDYNLM

SEQ ID NO: 24807 - protein, 301 aa, Ephydatia fluviatilis
RIIHGQGYSDADRADFRTLVFRNIFTAVNALTEAMTSLKIPFERASNKESGAVYGRKKDEEETVLSESDRDKLKAFWLDRGVQSCFERRNEFQISDSAKYYLDALDRICISNYLPTIDDVLRIRIATTGIVEYTFQMRKDVIFRMVDVGGQRSERRKWIHSFEDVKAIIFLTAINEYDQVLQEDAGVNRLLESLALFGTILTYPFFLKCAIILFMNKTDIFAEKIQKSHLKLHFPEYTGPLQDVESGRQFILQKFREKFDSERLFSHHFTCATDTENIKLVFQAVREQILQENIDTIFNNG

SEQ ID NO: 24808 - protein, 304 aa, Ephydatia fluviatilis
KIIHGDGYSKDELESFRPVIYGNLAASMRVVVSNMENLGIPFSDTTNREYANMILSLSTSIPNCNSLPSEVAEAFRRLWNDQGVRACFSRAYEYQLNDSAPYYFENMDRLLKPDYVPDEQDVLRSRVQTTGIIETSFRVEKLVYRVVDVGGQRSERRKWIQCFDDVKAVLFVVALNGYDMTLFEDGKTNRLEESLNLFQAICNNKFFVKTSMILFLNKVDLFENKVLTSDRQLRNYFSSYQGPDRNPEEAKKFIQSQFLERNMSKNKIIYPHFTTATNTSNIRVVFQAVLDAIIRENLEAANLL

SEQ ID NO: 24809 - protein, 307 aa, Ephydatia fluviatilis
KIIHGDGYSNEELDAFKHVVYKNLVASMAAIVRNMERLGISFSDPSNSVHADTLLALSSNQDFSSMPPKLAEAIKHLWSDQGVKACFKRAYEYQIEDSASYFLGDMDRLLQSGYVPNEQDVLRSRVQTTGIIETSFRVKKLIYRIVDVGGQRAERSKWIQCFDDVKAVLFVVALNGYDMTLAEDGVTNRMREALVLFEDICNKPIFARTSMILFLNKVDAFETKILDTDRHLRTFFPEFSGPDHDVEAAKEYIKSQFLACNKSRGKQITPHFTTATNTSNVRVVIDAVIEAIIRENLESIGLIREDE

SEQ ID NO: 24810 - protein, 302 aa, Ephydatia fluviatilis
KIIHESGFNREECKQYRPVVYSNAIQSLAAIIKGMDLLGINFASPARREDAMLLFEVTARHEDTEPFTPELLAAMKRLWGDTGVQLCFRRSSEYQLNDSAKFYLDSLDRIGDKRYIPTEQDILRTRVKSTGIVEYEFSYKGLHFRVVDVGGQRSERKKWIHCFEDVTAILFFVALSEYDMSLREDATVNRMEEALRLFNSILNNKWFLETSVILFLNKKDLFEEKLRCKPLSHCFPNYVGENTFQDGANFIRDRFVSLNRNPDKKTVYTHITCATDTNNIQIVFQSVTDIVISEHLRGAGLL

SEQ ID NO: 24811 - protein, 301 aa, Ephydatia fluviatilis
KIIHENGYTAEECEQYRPVVYSNTVQSMMAIIKAMDTLAIPYENGDRREDAKELCAMASQSDEIRFTEDLVVRMKRLWADGGVKECVRRAREYQLNDSAEYYLSSLDRLAQPDYIPTEQDVLRTRVKTTGIVESFFTYQGLNFKIVDVGGQRSERKKWIHCFEGVTSIIFCVALSGYDLLLAEDEKTNRMLESMKLFHSICNNRWFENTSIILFLNKKDLFAEKIQLSPLTICFPEYTGANSYDEASKYIREKFEALNDKKEKKQIYTHFTCATDTGNIRHVFKDVTDVIVKNNLRDVGLF

SEQ ID NO: 24812 - protein, 103 aa, Lolium temulentum
  unsure (1)..(103): unsure at all Xaa locations
MSGRGKGGKGLGKGGAKRHRKVLRDNIQGITKPAIRRLARRGGVKRISGLIYEETRGVLKIFLENVIRDAVTYTEHAXRKTVTAMDVVYALKRQGRTLYGFGG

SEQ ID NO: 24813 - protein, 367 aa, Rattus norvegicus
EPRGTAGVVPVVPGEVEVVKGQPFDVGPRYTQLQYIGEGAYGMVSSAYDHVRKTRVAIKKISPFEHQTYCQRTLREIQILLRFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEAP

SEQ ID NO: 24814 - protein, 539 aa, Magnaporthe grisea
MPSLGFLKKKRTRDGNNDNSSQPASPVTPTAAQSFEQAQVLGAPSAINNSHAHTQQQSYLVPQPGYSVGTEVQAQQPQMNSISQQQQQAFAPPAHTPSPGTIDPQQSLPSISNLMNPAVQQQNSQPSANFQPQSQSQSQSQSQFPLPPSHGNGDQSQQQNFQVQQQIQSQQDAMDIQPSQVQDQSHSQQAQPQHQPQHHVQHHVNHAHQGSQDQQTRVTKGKYSLTDFEILRTLGTGSFGRVHLVQSRHNQRFYAVKVLKKAQVVKMKQVEHTNDERKMLGEVKNPFLITLWGTFQDCRNLYMVMDFVEGGELFSLLRKSGRFPNPVAKFYAAEVTLALEYLHAKNIIYRDLKPENLLLDRHGHLKITDFGFAKRVPDKTWTLCGTPDYLAPEVVSNKGYNKSVDWWSLGILIYEMLCGYPPFWDSGSPMKIYENILKGKVRYPAYINPDAQDLLQRLITADLTKRLGNLYGGSQDVRNHPWFAEVTWDRLARKDIDAPYTPPVKAGAGDASQFDRYPEETERYGQTGHDEYGNLFPGF

SEQ ID NO: 24815 - protein, 262 aa, Streptomyces sp.
MSDAADRVALVTGGTSGIGLAVGRRKLALDGTRVFLCARDESAVTGTVKELQASGLEVEGTSCDVRSTDAVDRLVRTARNPLRAIDIVVNNAGRGGGGVTAQITDDLWSDVVDTNLGGAFRVTRAVLTGGGMQEHGWGRIINIASTGGKQGVALGAPYSASKSGLIGFTKAVALELARTGITVNAVCPGYVETPMAQGVRQRYAAFWGITEDDVLEKFRAKIPLGRYSTSDEVAGMVHYLVSDSADSITAQAINVCGGLGSY

SEQ ID NO: 24816 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGDGTIDYLEFITATMHLNKIDKEDHLYAAFQHFDGDNSGFITMEELEQALIKHGMGDPDTLKEIIREVDTDHDGRINYDEFVAMMRKGTPGHQEGHRRSISNMAPVGAPRQHHHK

SEQ ID NO: 24817 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGNGTIDYLEFITATMHLNKIEKEDHLYAAFQHFDEDSSGFITMEELEQALIKHGMGDPDTLKEIIREVDTDHDGRINYDEFVAMMRKGTPGHQEGHRRSISNMAPVGAPRQHHHK

SEQ ID NO: 24818 - protein, 155 aa, Cricetulus griseus
KIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLLDLERLVTPGYVPTEQDVLRSRVKTAGIIETQFSFKDLNFRMFDVGGQRSEP

SEQ ID NO: 24819 - protein, 325 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 24820 - protein, 326 aa, Homo sapiens
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 24821 - protein, 363 aa, Arabidopsis thaliana
MLGILRQRAIDGASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPIPYTANLERLALPQIEDIVRASKRACYRSK

SEQ ID NO: 24822 - protein, 907 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLLLSVRSGAAVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 24823 - protein, 875 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 24824 - protein, 801 aa, Nectria haematococca mpVI
VEVKGEILELKNTINQMVDRLGTFAVEVSKVAREVGTDGTLGGQAQVANVEGKWKDLTENVNTMASNLTVQVRSISTVTQAIANGDMSQKIKVEANGEIQVLKETINNMVDRLSSFCYEVQRVAKDVGVDGKMGAQADVAGLDGRWKEITTDVNTMASNLTTQVRAFSDITNLATDGDFTKLVDVEASGEMDELKRKINQMISNLRDSIQRNTQAREAAELANKTKSEFLANMSHEIRTPMNGIIGMTQLTLDTDLTQYQREMLNIVNNLANSLLTIIDDILDLSKIEARRMVIEEIPYTLRGTVFDALKTLAVKANEKFLDLTYKVDSSVPDYVIGDSFRLRQIILNLVGNAIKFTEHGEVSLTIKERVEQRNVRPGEYAVEFIVEDTGIGIAKDKLDLIFDTFQQADGSMTRKFGGTGLGLSISKRVVNLMGGDLWVISEQGKGSEFHFTCLVKLAHDDAAMIEQQIRPYRGHQVLFVDKAQSKGGASIKGMLEQIGLHPVVVESEKSPALTRLQASGSLPYDAILVDSIDTARRLRAVDDFKYLPIVLLAPVVHVSLKSCLDLGITSYMTTPCKLIDLGNGMIPALENRATPSLADNTKSFEILLAEDNTVNQRLAVKILEKYHHVVTVVGNGWEAVEAVKRKKFDVILMDVQMPIMGGFEATGKIREYERGIGTHRTPIIALTAHAMMGDREKCIQAQMDEYLSKPLQQNHLIQTILKCATLGGPLLEKNRERELALHAEAKSSKHKEGGQGLLRPALESRSFTSREPLSGNGKESPALLSPDEDPMARVYMRSLSS

SEQ ID NO: 24825 - protein, 524 aa, Pisum sativum
MEPLSSTKQINNNNNNLAKPSSLHVETQPLEPSPLRKIMVVASIAAGVQFGWALQLSLLTPYVQLLGIHHTWAAYIWLCGPISGMLVQPVVGYHSDRCTSRFGRRRPFIAAGSIAVAIAVFLIGYAADLGHSFGDNLDKKVRPRAIGIFVVGFWILDVANNMLQGPCRALLGDLCAGNQRKTRNANAFFSFFMAVGNVLGYAAGAYSKLYHVFPFTKTEACNVYCANLKSCFFLSIALLTVLATAALIYVKETPLIAEKAVVTAEDGGSNGGMPCFGQLSGAFKELKRPMWILLLVTCLNWIAWFPFLLFDTDWMGKEVYGGTVGEGHAYDMGVRAGALGLMLNSVVLGATSLGVDILARGVGGVKRLWGIVNFLLAICLGLTVLVTKLAQHSRQYAPGTGGLQDPLPPSGGIKAGALTLFSVLGIPLAITYSIPFALASIFSSTSGAGQGLSLGVLNLAIVIPQMFVSVLSGPWDALFGGGNLPAFVVGAVAALASGILSMILLPSPPPDMAKSVSATGGGFH

SEQ ID NO: 24826 - protein, 181 aa, Danio rerio
EKLVTSIQRRYFQPPSVCVNAAGITQDEFILKMEEDDFDKVIKVNLKGTFLVTQAVSKALVSAGSVKGSIITVGSIVGKVGNIGQVNYASSKAGVQGLTRTTAKELSKFGIRCNCVLPGFITTPMTDKVPEKVIDKITSIIPLGRMGEPAEVRDACAFLASDDSRYITGVSIEVAGGLFIG

SEQ ID NO: 24827 - protein, 333 aa, Streptomyces hygroscopicus
MSAALTDGTVQGQQQCDTRLVGLYEADEAGSDLTLALSLAHGRAEAAARGIPLHTHLWQLYGGRTAPGLPRLMVNVFSGGIHRTGPPRGFQQVMVLPATGGLHTDIEVADRVFTAAHRNVERRFGPVPLSASSGLMVPLDSAGQLDLLQAAVAETGHTEVCTLGVDVAAEHLLTEPGRYRFGDRVLTAPDFADHLADLAHRFRMSFLEDPFDAADEAGWARLRGALPATTSVVGDDLFATDATRIEPGRADGILLKLSQAGTVTATLAAAAAARRAGMLLSVSHRSGETEDTAMCDLAVAVGAELIKVGGPRRGDRLAKYNQLLRLDESVAAP

SEQ ID NO: 24828 - protein, 565 aa, Acer pseudoplatanus
MGLMYRFLGFMFLGCLLFCKAEGAIRHYDFVVKESNFSRLCSTKSMLTVNDSFPGPEIHVHKGDTVFVNVHNQGTYGITIHWHGVKMPRNPWSDGPEYVTQCPIPAGTNFTQEINFSTEEGTLWWHAHSDWSRATVHGAIIIYPAHGTTYPYPKPYGEQTIVLASWYKADVMEVYEEAVASGAEFNTSDAFTINGQPGALFDCSTGTTFRLPVKKGETYLLRIINAILNEEMFFGIAQHNLRVVGTDGFYTKPINTEYIMITPGQTMDVLVTANQPASYYYMAASPFSDSEAAFDNATTTAILQYIGNQSAPSPIPLPTLPGTNDTTAASNFTTKFRSLASSDHPISVPKNITKHILMTVSVNLIFCPNDSCSGTPDGDRLGASLNNQSFVFPSTDILEAYTRNNFSEFTTDFPLEPPIYFNFTGDVNVTVYTGQGTKVIELEYGEVVELVYQGTNVGNAQNHPMHLHGFSFYLVGTGLGNFNNQTDPDNYNLIDPPEVNTIQLPKKGWAAIRFVADNPGVWFLHCHFERHTTWGMAVAIIVKNGGTTSTSMRPRPAYMPPCPNS

SEQ ID NO: 24829 - protein, 224 aa, Oryza sativa (japonica cultivar-group); identical to SEQ ID NO: 3079

SEQ ID NO: 24830 - protein, 239 aa, Oryza sativa (japonica cultivar-group)
MGRGKVVLQRIENKISRQVTFAKRRNGLLKKAYELSILCDAEVALVLFSHAGRLYQFSSSSNMLKTLERYQRYIYASQDAAAPTSDEMQNNYQEYVNLKAHVEILQQSQRNLLGEDLAPLATNELEQLESQVVRTLKQIRSRKTQVLLDELCDLKRKEQMLQDANRVLKRKLDEIDVEAAPPQPPWNGNCSNGHGGGGGVFSSEPPQPEHFFQALGLHAVDVNQPPAPPPGGYPPEWMA

SEQ ID NO: 24831 - protein, 267 aa, Oryza sativa (japonica cultivar-group); identical to SEQ ID NO: 3633

SEQ ID NO: 24832 - protein, 230 aa, Oryza sativa (japonica cultivar-group); identical to SEQ ID NO: 3719

SEQ ID NO: 24833 - protein, 231 aa, Ovis aries
YDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDV

SEQ ID NO: 24834 - protein, 437 aa, Homo sapiens
GNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 24835 - protein, 484 aa, Medicago sativa
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKPVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVKEEVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 24836 - protein, 335 aa, Pseudomonas putida
MALNKEAPEFDIDDDVLLMETGIVLETDVVSDEPAVPSVRTRAKSGSSLKQHKYIDYTRALDATQLYLNEIGFSPLLSPEEEVHFARLSQKGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIATLLEKPVAEVKRMLGLNERVSSVDVSLGPDSDKTLLDTLTDDRPTDPCELLQDDDLSQSIDQWLGELTDKQREVVVRRFGLRGHESSTLEDVGLEIGLTRERVRQIQVEGLKRLREILEKNGLSSESLFQ

SEQ ID NO: 24837 - protein, 329 aa, Pisum sativum
MTITRFVLNEQSKRPESRGDFTILLSHIVLGCKFVCSAVNKAGLAKLIGLAGETNIQGEEQKKLDVLSNDVFIKALISSGRTCILVSEEDEEATFVEPSLRGKYCVVFDPLDGSSNIDCGVSIGTIFGIYMVKDNHAPTLDDVLQPGKNMLAAGYCMYGSSCTLVLSTGSGVNGFTLDPSLGEFILTHPDIKIPKKGKIYSVNEGNAKNWDGPTTKYVEKCKFPTDGSSPKSLRYIGSMVADVHRTLLYGGIFLYPADKKSPNGKLRVLYEVFPMSFLMEQAGGQSFTGKQRALDLIPTKIHERSPIFLGSYDDVEEIKALYAAEQKNA

SEQ ID NO: 24838 - protein, 56 aa, Brassica napus
HALDALSQEDDWTGLSEEPVHQLEHTDAAGNNGGGGGYWDAGQAKMKKPQQRRRKK

SEQ ID NO: 24839 - protein, 53 aa, Brassica napus
ALSQEDDWTGLSQEPVQHQDQTDAAGINGGGRGGYWEAGQTTIKKQQQRRRKK

SEQ ID NO: 24840 - protein, 52 aa, Brassica napus
ALSQEDDWTGLSEEPVHQLEHTDAAGNNGGGGGYWDAGQAKMKKPQQRRRKK

SEQ ID NO: 24841 - protein, 59 aa, Brassica oleracea
GTHHALDALSQEDDWTGLSEEPVHQLEHTDAAGNNGGGGGYWDSGQAKMKKPQQRRRKK

SEQ ID NO: 24842 - protein, 61 aa, Brassica oleracea
SGTHLALDALSQEDDWTGLSQEPVQHQDQTDAAGINGGGRGGYWEAGQTTIKKQQQRRRKK

SEQ ID NO: 24843 - protein, 51 aa, Brassica rapa
ALDALSQEDDWTGLSEEPVQHQDHTDAAGINCGGRGGHWEAGQTTIKKQQQ

SEQ ID NO: 24844 - protein, 109 aa, Brassica napus
RIAGAGRIIGVDLNPKRFEEAKNFGVTDFVNPKEHDKPVQQVIAEMTNGGVDRSVECTGSIQAMIQAFECVHDGWGVAVLVGVPSKDDAFKTHPMNLLNERTLKGTFFG

SEQ ID NO: 24845 - protein, 102 aa, Brassica napus
  unsure (1)..(102): unsure at all Xaa locations
IIGVDLNPNRFEEAKKFGVTEFVNPKXHDKPVQQVITEMTDGGVDRSVKCTGSVQAMIQAFECVHEGWGVAVLVGVPRQDDAFKTHPMNFLNERTLKGTFFG

SEQ ID NO: 24846 - protein, 110 aa, Brassica oleracea
ARIAGAGRIIGVDLNPKRFEEAKNFGVTDFVNPKEHDKPVQQVIAEMTNGGVDRSVECTGSIQAMIQAFECVHDGWGVAVLVGVPSKDDAFKTHPMNLLNERTLKGTFFG

SEQ ID NO: 24847 - protein, 98 aa, Brassica rapa
DLNPKRFEEAKNFGVTDFVNPKEHDKPVQQVIAEMTNGGVDRSVECTGSIQAMIQAFECVHDGWGVAVLVGVPSKDDAFKTHPMNLLNERTLKGTFFG

SEQ ID NO: 24848 - protein, 763 aa, Mycobacterium tuberculosis
MPPVPAPRALAPLPPAPPAPAEPKSKPPFPPAPPAPPCWMLVSAAPPCPPAPPAPPKPKSKAPFPPVPPAPPARELAPPLPPAPPEAPRESRPALPPCPPPPVVIPDPPEPAAPPVPPAPNSPPFPPFPPAPKFVPAPPVPPVPNSPPFPPFPPAALNPPAPPAPPLANSPPLPPAPPTPAGTPPAAPWPPVPAAPKSKPASPPRPPAPPMPATPMEFPPLPPVPPDPISKETPPAPPAPPIPPAPVPIPPVPPLPPVPNKIPPAPPAPPVAVAAVLVAPCPPLPPLPNNHPPAPPAAPVPGVPLAPLPNSHPPAPPSAPVPGVPLAPLPISGRPVSVWKGSFTTLSTFCCRVCSGEVLAGALNPSRPSRSPLTTTTPALPAPIPPLPPLPPLPINTAVPPIPPLPPVTALAPPLPPLAPLPISPGVPPAPPIPPGKPWTTPPLAPAPPEPKTVPVLPPGPSCPPSEKPNPPAPPEPPEPKSSPALPPAPPAPSMPSAVRVPPSPPIPPAPPAAPRASMPALPPAPPSPPATRLCPPLPPSPPAPNSPPAPPAPPTPPKLLSANPPCPPVPPAPNRPPAPPAPPAPPELPAPPDPPTPPVANSPPAPPAPPAPPSALPFVNPPAPPTPAAPKSRPALPAAPPAPPAPPVRATTPPPAPPAPPAPNSMALPPAPPDPPIPLLATPPAPPAPPLPMSPPAPPLPPAAPDPPAPPLTINQPPSPPLAPVPGAPLAPLPINGRPVFARKNSLIGSSSGDTAAASAAA

SEQ ID NO: 24849 - protein, 291 aa, Arabidopsis thaliana
MMKRLSSSDSVGGLISLCPTTSTDEQSPRRYGGREFQSMLEGYEEEEEAIVEERGHVGLSEKKRRLSINQVKALEKNFELENKLEPERKVKLAQELGLQPRQVAVWFQNRRARWKTKQLEKDYGVLKTQYDSLRHNFDSLRRDNESLLQEISKLKTKLNGGGGEEEEEENNAAVTTESDISVKEEEVSLPEKITEAPSSPPQFLEHSDGLNYRSFTDLRDLLPLKAAASSFAAAAGSSDSSDSSALLNEESSSNVTVAAPVTVPGGNFFQFVKMEQTEDHEDFLSGEEACE

SEQ ID NO: 24850 - protein, 60 aa, Brassica napus
GTHLALDALSQEDDWTGLSEEPVQHQDHTDAAGINCGGRGGHWEAGQTTIKKQQQRRRKK

SEQ ID NO: 24851 - protein, 212 aa, Triticum aestivum
GFGKLVIVAGDHGKESKDREEQAEFKRMYSLIEEYKLKGHIRWISAQMNRVRNGELYRYICDTKGAFVQPAFYEAFGLTVIEVHECGLPTIATCHGGPAEIIVNGVSGLHIDPYHSDKAADILVNFFEKCSEDPSYWDKMSEGGLKRIYEKYTWKLYSERLMTLTGVYGFWKYVSNLERRETRRYLEMFYALKYRSLAAAVPLAVDGESSDN

SEQ ID NO: 24852 - protein, 261 aa, Streptomyces peucetius
MSEAADRVALVTGGTSGIGLAVVRKLAQDGTRVFLCARDESAITGTVKELQASGLEVDGAPCDVRSTADVDRLVQTARNRFGPIDIVVNNAGRGGGGVTAEITDDLWLDVVDTNLSGAFRVTRAVLTGGAMQEHGWGRIISIASTGGKQGVALGAPYSASKSGLIGFTKAVALELAKTGITVNAVCPGYVETPMAQGVRQRYAAFWGITEDDVLEKFQAKIPLGRYSMPEEVAGMVHYLASDSADSITAQAINVCGGLGSY

SEQ ID NO: 24853 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 24854 - protein, 298 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGHPL

SEQ ID NO: 24855 - protein, 296 aa, Pennisetum glaucum
IIESVGEGVTDVAPGDHVLPVFTGECKECPHCKSAESNMCDLLRINTVRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 24856 - protein, 250 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 24857 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 24858 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 24859 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 24860 - protein, 318 aa, Arachis hypogaea
VMHRDLKPESFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 24861 - protein, 503 aa, Homo sapiens [sequence omitted]

SEQ ID NO: 24862 - protein, 443 aa, Aspergillus niger
MRWLLTSSALLVPAAALVRPDGVGLTPALGWNSWNAYSCDIDADKIVTAANEVVNLGLKDLGYEYINIDDCWSVKSGRNTTTKRIIPDPDKFPNGISGVADQVHALGLKLGIYSSAGLTTCAGYPASLGYEEIDAQSFAEWGIDYLKYDNCGVPTNLTDQYTYCVPDSTDGSNYPNGTCVNLTDAAPQGYDWATSTTAKRYQRMRDALLSVNRTILYSLCDWGQADVNAWGNATGNSWRMSGDITATWSRIAEIANENSFLMNYANFWGYPDPDMLEVGNGNLTLPENRAHFALWAMMKAPLIIGTPLDSIDTSHLTILSNKPLLTFHQDAVIGRPAYPYKWGYNPDWTFDPEHPAEYWSGPTSSGEVFVLMLNSEGEVKTRSAVWEEVPELKDRGTKKNSKEKKGFKVTDAWTGKDLGCVKDKYEVKLQAHDVAVLVVGGQC

SEQ ID NO: 24863 - protein, 370 aa, Arabidopsis thaliana
MATLVDPPNGIRNEGKHYFSMWQTLFEIDTKYMPIKPIGRGAYGVVCSSVNSDTNEKVAIKKIHNVYENRIDALRTLRELKLLRHLRHENVIALKDVMMPIHKMSFKDVYLVYELMDTDLHQIIKSSQRLSNDHCQYFLFQLLRGLKYIHSANILHRDLKPGNLLVNANCDLKICDFGLARASNTKGQFMTEYVVTRWYRAPELLLCCDNYGTSIDVWSVGCIFAELLGRKPIFQGTECLNQLKLIVNIIGSQREEDLEFIVNPKAKRYIRSLPYSPGMSLSRLYPCAHVLAIDLLQKMLVFDPSKRISASEALQHPYMAPLYDPNANPPAQVPIDLDVDEDLREEMIREMIWNEMLHYHPQASTLNTEL

SEQ ID NO: 24864 - protein, 376 aa, Arabidopsis thaliana
MATPVDPPNGIRNQGKHYFSMWQTLFEIDTKYMPIKPIGRGAYGVVCSSVNRESNERVAIKKIHNVFENRIDALRTLRELKLLRHLRHENVVALKDVMMANHKRSFKDVYLVYELMDTDLHQIIKSSQVLSNDHCQYFLFQLLRGLKYIHSANILHRDLKPGNLLVNANCDLKICDFGLARTSNTKGQFMTEYVVTRWYRAPELLLCCDNYGTSIDVWSVGCIFAELLGRKPVFPGTECLNQIKLIINILGSQREEDLEFIDNPKAKRYIESLPYSPGISFSRLYPGANVLAIDLLQKILVLDPSKRISVTEALQHPYMAPLYDPSANPPAQVPIDLDVDEDEDLGAEMIRELMWKEMIHYHPEAATINNNEVSEF

SEQ ID NO: 24865 - protein, 328 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSAGGSGNCTVL

SEQ ID NO: 24866 - protein, 282 aa, Zymomonas mobilis
MMSPISIPSIRLNDGNDLPAVGFGTYKLNGSAGVSDIVSAIKVGYRLLDSAFNYENEGAVGEVFREAGIARDKLRIVSKLPGRHHHFEEAIATVEESLYRAQLDYYDLYLIHWPNPSKDLYVEAWQALIEARKKGLIRSIGVCNFLPEHLERLIKETGVTPVVNQVELHPYFPQEEQRAWDKAHGIVTESWSPLGRASKLLQDDTIKKIADRLGKSIPQVILRWHVQLGAIPIPKASSKERQIENLSLFDFELSPQDVEIIATLARPDGRLADQDPARYEEF

SEQ ID NO: 24867 - protein, 707 aa, Oryctolagus cuniculus
MGMSKSLSCFGYPLSIFFIVVNEFCERFSYYGMRALLILYFRNFIGWDDNLSTVIYHTFVALCYLTPILGALIADAWLGKFKTIVWLSIVYTIGQAVTSLSSVNELTDNNHDGTPDSLPVHVAVCMIGLLLIALGTGGIKPCVSAFGGDQFEEGQEKQRNRFFSIFYLAINAGSLLSTIITPMVRVQQCGIHVKQACYPLAFGIPAILMAVSLIVFIIGSGMYKKFKPQGNILSKVVKCICFAIKNRFRHRSKQFPKRAHWLDWAKEKYDERLIAQIKMVTRVLFLYIPLPMFWALFDQQGSRWTLQATTMSGRIGILEIQPDQMQTVNTILIIILVPIMDAVVYPLIAKCGLNFTSLKKMTIGMFLASMAFVAAAILQVEIDKTLPVFPKANEVQIKVLNVGSENMIISLPGQTVTLNQMSQTNEFMTFNEDTLTSINITSGSQVTMITPSLEAGQRHTLLVWAPNNYRVVNDGLTQKSDKGENGIRFVNTYSQPINVTMSGKVYEHIASYNASEYQFFTSGVKGFTVSSAGISEQCRRDFESPYLEFGSAYTYLITSQATGCPQVTEFEDIPPNTMNMAWQIPQYFLITSGEVVFSITGLEFSYSQAPSNMKSVLQDRWLLTVAVGNIIVLIVAGAGQINKQWAEYILFAALLLVVCVIFAIMARFYTYVNPAEIEAQFEEDEKKKNPEKNDLYPSVAPVSQTQM

SEQ ID NO: 24868 - protein, 257 aa, Rhodobacter sp. DSMZ 12077 [sequence omitted]

SEQ ID NO: 24869 - protein, 379 aa, Citrullus lanatus
MAMKCMMSTGESKEMKSKLHRVEFGCSEESMVPENFVWPDEFKAKDGAPELHVPHIDLHKFLNGNESDIEEATRLVDEACRKHGFFVLVNHGVDMELIKGVHECMDEFFTLPFDVKQKSQRKFGENYGYANSFIGRFSNNLPWKETLSLPYVANHNSTSVQDFVSKCVGPELSHQGKVYQECGKALSDLSLKIVELLGLSLGVPKEKFKKFYEDNDSIIRLNYYPPCEKPELTLGTGPHCDPTSITILHQDHVSGLQVYVDDEWHSIPPTKDSFVINIGDTFMALTNGVYKSCFHRAVVNCKEVRKSMAFFLCPAADKVVRAPDEVVEKNPPRKFPDYTWPMLLELTQKFYRADSNTFQAFIPWLEKQKSANTIAPPAL

SEQ ID NO: 24870 - protein, 732 aa, Leishmania tarentolae
MGDHEVSLCHVSHYNHANYLDLVPLPTVSDDMGFESLCHDSASGRIRIAHPTPALNPNAAEELLSPCPTCRLEQCHIHFQPANHNSPSPAHPATGGKEAAEVRDTDAEESLLPTQTVLSSPECSAHIPAQLQMVTGGAPADSTEDQRTPVAASQNLVDLFFLEGSQAVDGVCFSPYPIYGWRTAEERQAAIWEVFRTYNVATRLPVSPAALAAAQSRYSCYKQSATAPTNNRVAETREQYWRRLANLYIQKGVKAASSAAHNAATTVTNGAVPVAPTCDPEDPFYIIDLGRVVEQMARWRHELPMVRPYFAVKSNPQAAVLEVLSALGAGFDCASREEIQMVLRNNLVATPDDIIFANPCKQLSDMREAQACGVTYVTVDNPLEMEKISRVMPSARAIIRIKTNDSKAQCSFSTKFGASLEDVEGLLQVARQFNVAVCGVSFHVGSGNYDESAYVSAVRDAYQVFQQAAKYGFHCTILDIGGGFPGTEAVEGSGSASFESIARRIRPVLVELFGGGEVTIISEPGRYFTAASHALLMNGFASRTLPLSEVEVSRQAFQSVVSMQEPREHQYYVNDGLYHSFNCILFDHAHPKLLLLNDGDGADEVQSGTEAAAAYSDEEGGKSPSGPLANDSLFMSAWDRRRNLTSRPLRITTIFGPTCDSMDCILKKQPFPEMKLGDWLLVPDMGSYTTAAAGVFNGFATRRLEFVSSADLSARSRAVHAHEGNTFEFVSE

SEQ ID NO: 24871 - protein, 263 aa, Torenia fournieri
FFELLNHGISPEFMDTVERLTKDHYKKCMELRFKEMVASKGLEAVQSQADDIDWESTFYVKHLPESNISEIPDLDDDYRKVMKEFAAQIEKLAEELLDLLCENLGLEKGYLKKVFYGSKGPPFGTKVSNYPPCPKPDFIKGLRAHTDAGGIILLFQDDKVSGLQLLKDGEWVDVPPMKHSIVINLGDQLEVITNGKYKSVMHRVIAQTDGNRMSIASFYNPGTDAVIYSAPALVEKEEEKKDLYPKFVFDDYMKLYAGLKFQA

SEQ ID NO: 24872 - protein, 367 aa, Hyacinthus orientalis
MGDPVTFQFFPVGEPEEEESPGGESTVAAGGAPRGHWAEVKFVEKEADVSPAIKKSRRGPRSRSSQYRGVTFYRRTGRWESHIWDCGKQVYLGGFDTAHAAARAYDRAAIKFRGVDADINFNLSDYNEDLKQMMNLAKEEFVHILRRQSTGFSRGSSKYRGVTLHKCGHWEARMGQFLGKKAYDKAAIKSSGREAVTNFEPSSYEREVLTEADSDAIGHDIDLNLRISQPNVSSPKRRDNPVGVQFHLGSFESSDAKKAMIDTHSSILVGQPHTAAMTSEASRVWSALYPGFYPPIELRAKDKMSMVGSAALPNWTWQLHGPMPSPMFTSAASSGFATTHATSSITPPASHHLQFPPPPNTNYYSRS

SEQ ID NO: 24873 - protein, 312 aa, Medicago sativa subsp. sativa
MGSVEIPTKVLTNTSSQLKMPVVGMGSAPDFTCKKDTKDAIIEAIKQGYRHFDTAAAYGSEQALGEALKEAIELGLVTRDDLFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNAHGIVLTAFSPVRKGASRGPNEVMENDMLKEIADAHGKSVAQISLRWLYEQGVTFVPKSYDKERMNQNLRIFDWSLTKEDHEKIAQIKQNRLIPGPTKPGLNDLYDD

SEQ ID NO: 24874 - protein, 312 aa, Medicago sativa subsp. sativa
MGSVEIPTKVLTNTSSQLKMPVVGMGSAPDFTCKKDTKDAIIEAIKQGYRHFDTAAAYGSEQALGEALKEAIELGLVTREELFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNANGIVLTAFSPLRKGASRGPNEVMENDMLKEIADAHGKSVAQISLRWLYEQGVTFVPKSYDKERMNQNLCIFDWSLTKEDHEKIDQIKQNRLIPGPTKPGLNDLYDD

SEQ ID NO: 24875 - protein, 509 aa, Rattus norvegicus
MPSGFQQIGSEDGEPPQQRVTGTLVLAVFSAVLGSLQFGYNIGVINAPQKVIEQSYNATWLGRQGPGGPDSIPQGTLTTLWALSVAIFSVGGMISSFLIGIISQWLGRKRAMLANNVLAVLGGALMGLANAAASYEILILGRFLIGAYSGLTSGLVPMYVGEIAPTHLRGALGTLNQLAIVIGILVAQVLGLESMLGTATLWPLLLAITVLPALLQLLLLPFCPESPRYLYIIRNLEGPARKSLKRLTGWADVSDALAELKDEKRKLERERPLSLLQLLGSRTHRQPLIIAVVLQLSQQLSGINAVFYYSTSIFELAGVEQPAYATIGAGVVNTVFTLVSVLLVERAGQRTLHLLGLAGMCGCAILMTVALLLLERVPSMSYVSIVAIFGFVAFFEIGPGPIPWFIVAELFSQGPRPAAMAVAGFSNWTCNFIVGMGFQYVADAMGPYVFLLFAVLLLGFFIFTFLRVPETRGRTFDQISATFRRTPSLLEQEVKPSTELEYLGPDEND

SEQ ID NO: 24876 - protein, 426 aa, Catharanthus roseus
MGSSEETKSSKPEKSSSPAPEQSNVHVYPDWAAMQAYYGPRVAVPPYFSSAVASGHPPHPYMWGPPQPMMPPYGTPYAAIYAHGGVYTHPGVPLGSHANAHAGATSPGATEAIAASPLSIDTPTKSSANGSQGLMNKLRGFDGLAMSIGNGNTDSADGGTDHGISQSGDTEGSSDGSNGTTSKAGQKNKKRSREGTPANDRERKSLTPSSPSAAVNTNGSSEKAMRASKVPAAATEKVMGAVLSPNMTTASELRNPSAANAKTSPAKVSQSCSSLPGETWLQNERELKRERRKQSNRESARRSRLRKQAETEELAKKVQTLTAENMTLRSEINKLTENSEHLRHESALLDKLKNARVMQAGEMNKYDELHRQPTGTADLLARVNNSGSTDKSNEEGGGDVFENRNSGTKLHQLLDASPRADAVAAG

SEQ ID NO: 24877 - protein, 763 aa, AKT8 murine leukemia virus
MGQTVTTPLSLTLEHWGDVQRIASNQSVDVKKRRWVTFCSAEWPTFGVGWPQDGTFNLDIILQVKSKVFSPGPHGHPDQVPYIVTWEAIAYEPPPWVKPFVSPKLSLSPTAPILPSGPSTQPPPRSALYPALTPSIKPRPSKPQVLSDNGGPLIDLLTEDPPPYGEQGPSSSDGDGDREEATSTPEIPAPSPMVSRLRGKRDPPAAVSTTSRAFPLRLGGNGQLQYWPFSSSDLYNWKNNNPSFSEDPGKLTALIESVLTTHAREETLIIIPGLPLSLGATDTMNDVAIVKEGWLHKRGEYIKTWRPRYFLLKNDGTFIGYKERPQDVDQRESPLNNFSVAQCQLMKTERPRPNTFIIRCLQWTTVIERTFHVETPEEREEWATAIQTVADGLKRQEEETMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPTQRLGGGSEDAKEIMQHRFFANIVWQDVYEKKLSPPFKPQVTSETDTRYFDEEFTAQMITITPPDQDDSMECVDSERRPHFPQFSYSASGTA

SEQ ID NO: 24878 - protein, 379 aa, Triticum aestivum
MATAGKVIECKAAVAWEAGKPLSIEEVEVAPPHAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 24879 - protein, 354 aa, Schizosaccharomyces pombe
MTIFNGLSESGESKKLNSKIEKQIENASKKDKKIYKVLLLGASDSGKSTISKQIKILNKNGFSQEEIMTFIPVIRRNLLESAKTLVKIIVQKGINLDPLGTHNCEIIEKFNPTPGELINANIGQAITSLWSANSVRSCTYGNDSVLIDSAPYFFSRADEICSRHYVPTIDDILRSRNSTLGISEISFTLDHLQIRMFDVGGQRTERRKWIYCFENVNSIIFCVSLNDYDKKLYERAAPERMRLVESISLFDSIINSQWFMHSSIILFLNKFDLFRKKLEMVPFQDYFPQYEGKNSVKSITRYILWLFVNPSINRAKHNIYPNITTAVDTSNIKVVFSAVKETILQHSLKEAGMF

SEQ ID NO: 24880 - protein, 891 aa, Schizosaccharomyces pombe
MEYRTNNVPVGNETKSAALNALPKIKISDSPNRHHNLVDAFMQSPSYSTQPKSAVEPLGLSFSPGYISPSSQSPHHGPVRSPSSRKPLPASPSRTRDHSLRVPVSGHSYSADEKPRERRKVIGNYVLGKTIGAGSMGKVKDAHHLKTGEQFAIKIVTRLHPDITKAKAAASAEATKAAQSEKNKEIRTVREAALSTLLRHPYICEARDVYITNSHYYMVFEFVDGGQMLDYIISHGKLKEKQARKFERQIGSALSYLHQNSVVHRDLKIENILISKTGDIKIIDFGLSNLYRRQSRLRTFCGSLYFAAPELLNAQPYIGPEVDVWSFGIVLYVLVCGKVPFDDQNMSALHAKIKKGTVEYPSYLSSDCKGLLSRMLVTDPLKRATLEEVLNHPWMIRNYEGPPASFAPERSPITLPLDPEIIREMNGFDFGPPEKIVRELTKVISSEAYQSLAKTGFYSGPNSADKKKSFFEFRIRHAAHDIENPILPSLSMNTDIYDAFHPLISIYYLVSERRVYEKGGNWNRIAKTPVSSVPSSPVQPTSYNRTLPPMPEVVAYKGDEESPRVSRNTSLARRKPLPDTESHSPSPSATSSIKKNPSSIFRRFSSRRKQNKSSTSTLQNSAPLETSQSPPTPRTKPSHKPPVSYKNKLVTQSAIGRSTSVREGRYAGISSQMDSLNMDSTGPSASNMANAPPSVRNNRVLNPRGASLGHGRMSTSTTNRQKQILNETMGNPVDKNSTSPSKSTDKLDPIKPVFLKGLFSVSTTSTKSTESIQRDLMLVMGMLDIEYKEIKGGYACLYKPQGIRTPTKSTSVHTRRKPSYGSNSTTDSYGSVPDTVPLDDNGESPASNLAFEIYIVKVPILSLRGVSFHRISGNSWQYKTLASRILNELKL

SEQ ID NO: 24881 - protein, 135 aa, Drosophila melanogaster
MPRYREWDLACKVYVGNLGSSASKHEIEGAFAKYGPLRNVWVARNPPGFAFVEFEDRRDAEDATAALDGTRCCGTRIRVEMSSGRSRDRRRGEGGSSGRSGSGRYRSRSPRRSRSPRSRSFSRDRRSRSDSRDRH

SEQ ID NO: 24882 - protein, 338 aa, Homo sapiens [sequence omitted]

SEQ ID NO: 24883 - protein, 379 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLSNTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 24884 - protein, 380 aa, Homo sapiens
KRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHTRKILHRDLKPQNLLINERGELKLADFGLARAKSVPTKTYSNEVVTLWYRPPDVLLGSTEYSTPIAMWGVGCIHYEMATGRPLFPGSTVKEELHLIFRLLGTPTEETWPGVTAFSEFRTYSFPCYLPQPLINHAPRLDTDGIHLLSSLLVYESKSRMSAEAALSHSYFRSLGERVHQLEDTASIFSLKEIQLQKDPGYRGLAFQQPGRGKNRRQSIF

SEQ ID NO: 24885 - protein, 550 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 24886 - protein, 111 aa, Synechococcus sp.
MSIYVGNLSYEVTEADLTAVFTEYGAVKRVQLPIDRETGRMRGFGFVEMSADAEEDAAIAALGGAEWMGRGLRVNKAKPREERSGGGSFGGGGGRRGGGGGGVTATTKLPA

SEQ ID NO: 24887 - protein, 225 aa, Geobacillus stearothermophilus
MMFKTLKEDIEVIFEQDPAARSYLEVILTYSGLHAIWAHRIAHALYKRKFYFLARLISQISRFFTGIEIHPGAKIGRRFFIDHGMGVVIGETCEIGDNVTVYQGVTLGGTGKEKGKRHPTIKDNCLIAAGAKVLGSITIGENSKIGAGSVVLKDVPPNSTVVGIPGRVVVRDGVKVKKDLNHTDLPDPIADRFRELEEEIVRLKSELEALKQQERKSEYEQHPAL

SEQ ID NO: 24888 - protein, 386 aa, Homo sapiens
MFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 24889 - protein, 294 aa, Picea abies
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVPGLEPAGIDLLSKMLCLEPSKRITARSALEHEYFKDLGFVP

SEQ ID NO: 24890 - protein, 479 aa, Mesembryanthemum crystallinum
RKLHDADVSEEDQNNLLKFLEKKETEYMRLQRHKMGADDFELLTMIGKGAFGEVRVCREKTTGHVYAMKKLKKSEMLRRGQVEHVKAERNLLAEVDSNCIVKLYCSFQDEEYLYLIMEYLPGGDMMTLLMRKDTLTEDEARFYVAETILAIESIHKHNYIHRDIKPDNLLLDKFGHLRLSDFGLCKPLDCSTLEEKDFEVNNGNGGSPSNEGSTKPRRTQQEQLQHWQKNRRMLAYSTVGTPDYIAPEVLLKKGYGMECDWWSLGAIMYEMLVGYPPFYSDDPMSTCRKIVNWRTHLKFPEEAKLSPEAKDLISKLLCNVTQRLGSNGAHEIKLHPWFNGIDWERIYQMEAAFIPEVNDELDTQNFEKFEEADNSSQSTSKAGPWRKMLSSKDLNFVGYTYKNFEIVNDYQVPGIAELKKKDTKPKRPSIKSLFEDESSDSSEAATSGDQSVQGSFLNLLPPQLEVSQTQTEVPPPKFT

SEQ ID NO: 24891 - protein, 572 aa, Mesembryanthemum crystallinum
SFDGNGNTDDEDDFYDDDDDDGRPDSVDDKVRKKEMRKGIDLATTLERIEKNFVITDPRLPDNPIIFASDSFLELTEFSRAEILARNRRFLQGPETDPATVAKIRDAIDNETDVTVQLINYTKTGKKFWNVFHLQPMRDQKGEVQYFIGVQLDGSEHVEPVQNSIPVASVMDSEKQVKETATNVDVAVRELPDANKKPEDLWANHSKVVQPKPHRKECSSWKAIEKIKESGEQIGLKHFRPVKPLGAGDTGSVHLVELCGTGEYFAMKAMDKNVMLNRNKVHRACAEREILDMLDHPFLPALYASFQTNTHICLITEYCPGGELFLLLDRQPTKVLKEDAVRFYAAEVIIALEYLHCQGIIYRDLKPENILLQSNGHVSLTDFDLSCLTSCKPQLLIPEIRDKKKQQKAQHQQTPIFMAEPMRASNSFVGTEEYIAPEIIAGAGIQGAVDWWALGILLYEMLYGFTPFRGKTRQKTFSNVLRKDLKFPATKQVSLDASQLIYQLLQKDPKDRLGACEGANEIKRHPFFRGANWALVRCMKPPVLDAPPLLGDPEKEANIVDPDMLDLQTNVF

SEQ ID NO: 24892 - protein, 500 aa, Spinacia oleracea
MEKVKAAKKFIENHYRSQMKNIQERKERRWVLEKQLASSDVPEEEQMSLIKDLERKETEFMRLKRNRICVNDFELLTIIGRGAYGEVQLCREKKSENIYAMKKLKKSEMLSRGQVEHVRAERNLLAEVDSHCIVKLFYSFQDAEYLYLIMEYLPGGDMMTLLMREDILTEKVAKFYIAQSVLAIESIHKHNYIHRDIKPDNLLLDKNGHMKLSDFGLCKPLDCATLSTIKENESMDDVSKNSMDIDASLPDAGNGHSWRSAREQLQHWQRNRRKLAFSTVGTPDYIAPEVLLKKGYGMECDWWSLGAIMYEMLVGYPPFYSDDPITTCRKIVHWRHYLKFPDDAKLTFEARDLICRLLCDVEHRLGTGGAEQIKVHAWFKDVEWDRLYETDAAYKPQVNGELDTQNFMKFDEANPPTPSRSGSGPSRKMLTSKDLSFVGYTYKNFDAVKGLKHSFDRKGSTSPKRPSLDSMFNENGMDYTAKHAEEMDVQMLTADDCMSP

SEQ ID NO: 24893 - protein, 724 aa, Spinacia oleracea
LTVTPIRDDKGCVIKFIGMQVEVSKFTEGINDKALRPNGLPKSLIRYDPRQKEAALGSIIEVVQTVKHPRSLSQPLSNNDADRREVAGKFNLDYMLPKLAEIDNVGTPGRLSSPSRLSTPGRQTPKIDASSRDSDKSSRKSARISLLGFKGRSSAKHERPPSPEPEFLIPKDIDRDDSWERAERERDVRQGIDLATTLERIEKNFVISDPRLPDNPIIFASDSFLELTEYTREEILGRNCRFLQGPETDQTTVQKIRDAIKEQRDITVQLINYTKSGRKFWNLFHLQPMRDQKGELQYFIGVQLDGSDHVEPLRNRLSERTEIQSAKVVKATAENVDEAVRELPDANSRPEDLWAIHSEPVYPRPHKRGSSSWAAIQKITAAGEKVGLEHFNPIKPLGCGDTGSVHLVELKVPENWFAMKAMDKSVMLNRNKVHRACVEREIISTLDHPFLPTLYASFQTSTHVCLITDFCPGGELFALLDKQPLKIFKEESARFYAAEVVIGLEYLHCLGIIYRDLKPENILLQKDGHLVLTDFDLSFLTSCNPHIINHPQPKKRRSRSQPPPTFIAEPVTQSNSFVGTEEYIAPEVITGASHTSAIDWWALGVLLYEMLYGRTPFRGKNRQKTFANIMHKDLTFPSSIPVSLSARQLIYALLNRDPATRLGTQGGASEIKEHPYFRGINWPLIRCMDPPTLEAPFKLIGRDPNAKEVKWDDDGVLASPMDFF

SEQ ID NO: 24894 - protein, 116 aa, Arabidopsis thaliana
LPEKKRRLTTEQVHLLEKSFETENKLEPERKTQLAKKLGLQPRQVAVWFQNRRARWKTKQQVAVWFQNRRARWKTKQLERDYDLLKSTYDQLLSNYDSIVMDNDKLRSEVTSLTEK

SEQ ID NO: 24895 - protein, 533 aa, Ricinus communis
MQSSTSKENKQPPSSQPHPPPLMVAGAAEPNSSPLRKVVMVASIAAGIQFGWALQLSLLTPYVQLLGIPHTWAAFIWLCGPISGMLVQPIVGYHSDRCTSRFGRRRPFIASGAAFVAIAVFLIGYAADLGHLSGDSLDKSPKTRAIAIFVVGFWILDVANNMLQGPCRALLADLSGTSQKKTRTANALFSFFMAVGNVLGYAAGAYTHLYKLFPFTKTTACDVYCANLKSCFFISIVLLLSLTVLALSYVKEKPWSPDQAVDNAEDDTASQASSSAQPMPFFGEILGAFKNLKRPMWILLLVTCLNWIAWFPFLLFDTDWMGREVYGGDSSGSAEQLKLYDRGVRAGALGLMLNSVVLGFTSLGVEVLARGVGGVKRLWGIVNFVLAVCLAMTVLVTKQAESTRRFATVSGGAKVPLPPPSGVKAGALALFAVMGVPQAITYSIPFALASIFSNTSGAGQGLSLGVLNLSIVIPQMIVSVAAGPWDALFGGGNLPAFVVGAVAALASGIFALTMLPSPQPDMPSAKALTAAFH

SEQ ID NO: 24896 - protein, 475 aa, Lycopersicon esculentum
MRITRARAKTLGSSGGLPPLHPSVRQDKKQGLVTQGTKSKRPAPDENKPANSSSTASQQPKRRAVLRDVTNVLCENPYMNCINGSKFQVKKFSDKRNSKVTPALLVKKPELEDRKESVIEEAKMVKVEESQEHCSQAHFKDHPFTQPSEYITAAQSGLVDLMPVNRSSCNDITLQTTTPKDESKVCLKQEGSNSLSIADIDSKHKDPLMCSLYAPDIYNNLQAMELDRRPSFNYMEKLQRDINKGMRSILIDWLVEVSEEYRLVPDTLYLTVHLIDRFLSEHYIEKQKLQLLGVTCMLIASKYEEICAPRVEEFCFITDNTYSKEEVVRMESLVLNFLGFQLAAPTTKKFLRRFVQASQASYEVPSVELEFMANYLAELTLAEYSFLKFLPSVTAASAVFLARWTLDQSNHPWNSTLEHYTTYKASDLKTTVLLLQDLQMNTSGSTLNAIREKYKQPKFKSVATLSSPKPVQSLF

SEQ ID NO: 24897 - protein, 378 aa, Lycopersicon esculentum
MVDEENKVPATAAASRGSNKRAFDSIAITNENDPLQISERPYPANKKRVVLGELNNLGNVIVSTQNSDLTETHESKRKIKLRKTRNVVKETVELKTSANSSPKDNLQKCSYGPLIYQHLHSLEVEERRRPLSNYMEKVQNNVIPSMRTVLVDWLVEVTEEYKLVSDTLYLAVSYIDRFLSSHVLAMEKLQLLGVSCMLVASKYEEISPPHVEDFCYITDNTYTREEVVNMERDLLSFLNFEISSPTTITFLRIFLKAAQDNLSFLTLQFEFLSCYLAELSLLDYSCVRFLPSMTAASAIFLSRFTVLPEVCPWTLALQQCTGYKPSELKDCVLVIHELQSSLMEATGRALREKYMNHKYKCVAALHPPDIPSCFFDDA

SEQ ID NO: 24898 - protein, 222 aa, Lycopersicon esculentum
GKIEIKKIENSTNRQVTYSKRRNGIFKKRKELTVLCDAKISLIMLSSTRKYHEYTSPNTTTKKMIDQYQSALGVDIWSIHYEKMQENLKRLKEINNKLRREIRQRTGEDMSGLNLQELCHLQENITESVAEIRERKYHVIKNQTDTCKKKARNLEEQNGNLVLDLEAKCEDPKYGVVENEGHYHSAVAFANGVHNLYAFRLQPLHPNLQNEGGFGSRDLRLS

SEQ ID NO: 24899 - protein, 159 aa, Lycopersicon esculentum
MVRGKTQMRRIENATSRQVTFSKRRNGLLKKAFELSVLCDAEVGLIIFSPRGKLYEFASSSTQEIIRGNKRHTKDRVQPENQAGPQYLQYMQHEAANLMKKIELLETAKRKFLGEGLQSCTLQEVQQIEKQLERSVGTIRARKLQVFKEQVERLKKKKK

SEQ ID NO: 24900 - protein, 764 aa, Nicotiana tabacum
MGSALLPDLGTQIVIPVCAVIGIVFSSFQWYLVSRVKVSSEHGATSPSSNKNNKNGYGDCLIEEEEGINDHNVVAKCADIQNAISEGATSFLFTEYQYVGIFMIAFAILIFLFLGSVEGFSTSSQPCTYNKEKRCKPALATAIFSTVSFLLGAITSVISGFLGMKIATYANARTTLEARKGVGKACLVQVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHDFTAMCYPLLISSMGILVCLITTLFATDFFEIKAVKEIEPALKNQLIISTAIMTVGIAIVTWTCLPSSFTIFNFGTQKVVKNWQLFLCVAVGLWAGLIIGFVTEYYTSNAYSPVQDVADSCSTGAATNVIFGLALGYKSVIIPIFAIAIAIFVSFTFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPQVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGILFKIF

SEQ ID NO: 24901 - protein, 516 aa, Solanum tuberosum
MENGTKREGLGKLTVSSSLQVEQPLAPSKLWKIIVVASIAAGVQFGWALQLSLLTPYVQLLGIPHKFASFIWLCGPISGMIVQPVVGYYSDNCSSRFGRRRPFIAAGAALVMIAVFLIGFAADLGHASGDTLGKGFKPRAIAVFVVGFWILDVANNMLQGPCRALLADLSGGKSGRMRTANAFFSFFMAVGNILGYAAGSYSHLFKVFPFSKTKACDMYCANLKSCFFIAIFLLLSLTTIALTLVRENELPEKDEQEIDEKLAGAGKSKVPFFGEIFGALKELPRPMWILLLVTCLNWIAWFPFFLYDTDWMAKEVFGGQVGDARLYDLGVRAGAMGLLLQSVVLGFMSLGVEFLGKKIGGAKRLWGILNFVLAICLAMTILVTKMAEKSRQHDPAGTLMGPTPGVKIGALLLFAALGIPLAATFSIPFALASIFSSNRGSGQGLSLGVLNLAIVVPQMLVSLVGGPWDDLFGGGNLPGFVVGAVAAAASAVLALTMLPSPPADAKPAVAMGLSIK

SEQ ID NO: 24902 - protein, 354 aa, Gallus gallus
MGCTLSAEERAALERSKAIEKNLKEDGISAAKDVKLLLLGAGESGKSTIVKQMKIIHEDGYSEEECKQYKVVVYSNTIQSIIAIIRAMGRLKIDFGEVARADDARQLFVLAGSAEEGVMTAELAGVIKRLWRDAGVQACFSRSREYQLNDSASYYLNDLDRISQPTYIPTQQDVLRTRVKTTGIVETHFTFKDLYFKMFDVGGQRSERKKWIHCFEGVTAIIFCVALSDYDLVLAEDEEMNRMHESMKLFDSICNNKWFTDTSIILFLNKKDLFEEKIKKSPLTICYPEYTGSNTYEEAAAYIQCQFEDLNRRKDTKEIYTHFTCATDTKNVQFVFDAVTDVIIKNNLKECGLY

SEQ ID NO: 24903 - protein, 335 aa, Homo sapiens
MRILHVNGFNGEGGEEDPQAARSNSDGEKATKVQDIKNNLKEAIETIVAAMSNLVPPVEVANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 24904 - protein, 317 aa, Phalaenopsis sp.
MELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 24905 - protein, 320 aa, Bromus inermis
MASAKAMMGQERQDHFVLKSGHAIPAVGLGTWRAGSDTAHSVQTAITEAGYRHVDTAAEYGVEKEVGKGLKAAMEAGIDRKDLFVTSKLWCTDLVPDRVRPALEKTLKDLQLDYLDLYLIHWPFRLKDGAHKPPEAGEVLEFDMEGVWKEMENLVKDGLVKDIGVCNYTVTKLNRLLQSAKIAPAVCQMEMHPGWKNDKILEACKKHGIHATAYSPLCSSEKNLAHDPVVEKVANKLNKTPGQVLIKWALQRGTIVIPKSSKDERIKENIQVFGWEIPEEDFQVLCSIKDEKRVLTGEELFVNKTHGPYKSASEVWDNEN

SEQ ID NO: 24906 - protein, 260 aa, Oryza sativa
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESNVFYLKMKGDYHRYLAEFKSGAERKEAAENTLVAYKSAQDIALADLPTTHPIRLGLALNLSVFYYEILNSPDRACNLAKQAFDDAIAELDTLGEESYKDSTLIMQLLRDNLTLWTSDNAEDGGDEIKEAAKPEGEGH

SEQ ID NO: 24907 - protein, 552 aa, Cucurbita pepo var. melopepo
SQIRHYKWEVEYMFWAPNCNENIVMGINGQFPGPTIRANAGDSVVVELTNKLHTEGVVIHWHGILQRGTPWADGTASISQCAINPGETFFYNFTVDNPGTFFYHGHLGMQRSAGLYGSLIVDPPQGKKEPFHYDGEINLLLSDWWHQSIHKQEVGLSSKPIRWIGEPQTILLNGRGQFDCSIAAKYDSNLEPCKLKGSESCAPYIFHVSPKKTYRIRIASTTALAALNFAIGNHQLLVVEADGNYVQPFYTSDIDIYSGESYSVLITTDQNPSENYWVSVGTRARHPNTPPGLTLLNYLPNSVSKLPTSPPPQTPAWDDFDRSKNFTYRITAAMGSPKPPVKFNRRIFLLNTQNVINGYVKWAINDVSLALPPTPYLGAMKYNLLHAFDQNPPPEVFPEDYDIDTPPTNEKTRIGNGVYQFKIGEVVDVILQNANMMKENLSETHPWHLHGHDFWVLGYGDGKFSAEEESSLNLKNPPLRNTVVIFPYGWTAIRFVADNPGVWAFHCHIEPHLHMGMGVVFAEGVEKVGRIPTKALACGGTAKSLINNPKNP

SEQ ID NO: 24908 - protein, 302 aa, Xenopus laevis
MDEYTKIEKIGEGTYGVVYKGRHKATGQVVAMKKIRLENEEEGVPSTAIREISLLKELQHPNIVCLLDVLMQDSRLYLIFEFLSMDLKKYLDSIPSGQYIDTMLVKSYLYQILQGIVFCHSRRVLHRDLKPQNLLIDSKGVIKLADFGLARAFGIPVRVYTHEVVTLWYRAPEVLLGSVRYSTPVDVWSIGTIFAEIATKKPLFHGDSEIDQLFRIFRALGTPNNEVWPEVESLQDYKNSFPKWKGGSLSANVKNIDKDGLDLLAKMLIYDPAKRISARKALLHPYFDDLDKSSLPDNQIRN

SEQ ID NO: 24909 - protein, 291 aa, Entamoeba histolytica
MTRYEKKQQLGEGTYGVVCKAWDTVCNRYVALKKIKQEREDDGIPVTSVREIAVLLELKHPNVVDLYDIYLEDKFLYLVFEFCDEDLYQFMSRSSKIPINETRSIVYQILQGLAFCHYHQILHRDMKPQNILINKNGTIKLGEFGLARLTTINDRKYTSEVVTLWYRAPEILLGATQYGGAIDIWSTAAIFGELINKEELFKGRCKIDQLFKIFSQLGTPTEDIWNGVTKLPFYLSTFPKWKAKDLHTIFHTDERAVDLLQKMFIYTPEKRISAADALKHPFFDPLNKPNN

SEQ ID NO: 24910 - protein, 133 aa, Canis familiaris
  unsure (1)..(133): unsure at all Xaa locations
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSXDR

SEQ ID NO: 24911 - protein, 880 aa, Cochliobolus carbonum
MSAAIDNEDLEELSISMPSQRRGAAQTSTTKAQDPAPPPPTALGTAVHETKSKDTKASQRLGQYTIVRTLGEGSFGKVKLATHQVSGQKVALKIINRKRLVTRDMAGRIEREIQYLQLLRHPHIIKLYTVITTPTEIIMVLEYAGGELFDYIVNHGKLQEAQARKFFQQIVCAVEYCHRHKIVHRDLKPENLLLDHDSNVKIADFGLSNIMTDGNFLKTSCGSPNYAAPEVISGKLYAGPEVDVWSCGVILYVLLVGRLPFDDEYIPTLFKKIAAGQYSTPSYLSPGATSLIRKMLMVNPVHRITIPELRQDPWFTTDLPAYLEPPAQEFFDSGADPNKAIDPKALAPLADAPRVQALHENVVTKLGKTMGYAKHDVQDALARDEPSAIKDAYLIVRENEMMRENPLLTNQDGVPVWNHQSPPAHDSYMEKFRPQSLNAVSRPQFIPPAPSDHERARQGSNASSQLASIRSPVSTIAILPSSLTEYHKAYMKGHPRPTNKISESEALPPTPEQTEEQRQISARRLKPNFRTMPEAGRTKPEPMTSLPTKKPRATKWQFGIRSRNQPAEAMLAIFKALKAMGADWEVPKIRRAGGRSGSRSRSTSQAPEDRKSKSRNHSQDSISSHSSDEDQGSRKGSPRREPLSVRNNGTSEQEARGRQKKHYNHTNDWGYHVPEDPWVIHARFLKEGMFPPGVAHPSSTHSSRVDLANDSSGARRRSSTNTSTSSAGHGVEGMTPSERAGSVSEDHVNPDEAVYIYMSIQLYSIDRDFFVVDFKCAGYERLVTNLVREIKASIPLSGSHQPPPHHQDGWDDEQGVWRRLDENEPLPEDLAKKLNEGGTEILRERTELVGAGRQEGEKIVTSPFPFLDVASTLILQLSGE

SEQ ID NO: 24912 - protein, 381 aa, Candida maltosa
MSESTVGKPITCKAAVAWEAAKPLSIEDVTVAPPKRHEVRIKLYDTGVCHTDAYTLSGVDPEGAFPVILGHEGAGIVESIGEGVTNVKVGDHVIALYTPECGECKFCKSGKTNLCGKIRATQGKGVMPDGTSRFTCKGKEILHFMGCSTFSQYTVVADISVVAINPKAEFDKACLLGCGITTGYGAATITANVQKGDNVAVFGGGIVGLSVIQGCAERGAAQIILVDISDKKEEWGQKLGATAFVNPTKLPEGTTIVDKLIEMTDGGCDFTFDCTGNVGVMRNALEACHKGWGTSVIIGVAAAGKEISTRPFQLVTGRTWKGAAFGGVKGRSQLPGIVNNYLDGKLKVEEFITHREPLAAINKAFEEMHAGDCIRAVVDLS

SEQ ID NO: 24913 - protein, 169 aa, Brassica napus
MSEVEYRCFVGGLAWATGDAELERTFSQFGEVIDSKIINDRETGRSRGFGFVTFKDEKSMKDAIDEMNGKELDGRTITVNEAQSRGGGGGGGRGGGGYGGRGGGGYGGGGGGYGDRRGGGGYGSGGGGRGGGGYGSGGGGYGGGGGRRDGGGYGGGDGGYGGGSGGGGW

SEQ ID NO: 24914 - protein, 142 aa, Sorghum bicolor
NSLHSAFSTYGEVLESKIILDRETQRSRGFGFVTFSTEEAMRSAIEGMNGKELDGRNITVNEAQSRGGRGGGGGGGYGGGRGGGGGYGRRDGGGGGYGGGGGGYGGGRGGYGGGGYGGGGGGYGGGSRGGGGYGNSDGNWRN

SEQ ID NO: 24915 - protein, 168 aa, Sorghum bicolor
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGREGGGYGGGGGGYGGRREGGGGYGGGGYGGGGGGYGGREGGGGYGGGGGYGGNRGDSGGNWRN

SEQ ID NO: 24916 - protein, 157 aa, Daucus carota
MAEVEYRCFVGGLAWATNDESLEQAFSQFGDITDSKIINDRETGRSRGFGFVTFKDEKSMRDAIEGMNGQELDGRNITVNEAQSRGSGGGGGRREGGGGGYGGGGGYGGRREGGGGGGYGGRREGGGGGYGGGGGGYGGRREGGDGGYGGGGGGSRW

SEQ ID NO: 24917 - protein, 547 aa, Leishmania donovani
MRASVMLCAALGGFLFGYDTGVINAALFQMKDHFGFSEHSWQYALIVAIAIAGAFVGAFISGFISAAFGRRPCIAVADALFVIGSVLMGAAPNVEVVLVSRVIVGLAIGISSATIPVYLAEVTSPKHRGATIVLNNLFLTGGQFVAAGFTAIMVVFTSKNIGWRVAIGIGALPAVVQAFCLLFFLPESPRWLLSKGHADRAKAVADKFEVDLCEFQEGDELPSVRIDYRPLMARDMRFRVVLSSGLQIIQQFSGINTIMYYSSVILYDAGFRDAIMPVVLSIPLAFMNALFTAVAIFTVDRFGRRRMLLISVFGCLVLLVVIAIIGFFIGTRISYSVGGGLFLALLAVFLALYAPGIGCIPWVIMGEIFPTHLRTSAASVATMANWGANVLVSQVFPILMGAIGVGGTFTIISGLMALGCIFVYFFAVETKGLTLEQIDNMFRKRAGLPPRFHEEGESGESGAGYREDGDLGRLATEDVCDLSSLGNRVVSFAKAEDAFTEVAMPDRHAVSNKFEERATSSSSDPQSLENQDEVRQAAIKAAPHEPK

SEQ ID NO: 24918 - protein, 345 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVFERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 24919 - protein, 323 aa, Homo sapiens
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 24920 - protein, 207 aa, Homo sapiens
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 24921 - protein, 496 aa, Homo sapiens [sequence omitted]

SEQ ID NO: 24922 - protein, 387 aa, Homo sapiens
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 24923 - protein, 756 aa, Homo sapiens
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGPGETLSVDQLVTFLQHQQREEAAGPALALSLIERYEPSETTKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQDRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 24924 - protein, 997 aa, Homo sapiens
MPSEKKISSANDCISFMQAGCELKKVRPNSRIYNRFFTLDTDLQALRWEPSKKDLEKAKLDISAIKEIRLGKNTETFTNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAQMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEKESSEENGKL

SEQ ID NO: 24925 - protein, 550 aa, Homo sapiens
MATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRASIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 24926 - protein, 552 aa, Homo sapiens
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYTAPEVISGRLYAGPEVDIWSCGVILYALLCGTLPFDDEHVPTLFKKIRGGVFYIPEYLNRSVATLLMHMLQVDPLKRATIKDIREHEWFKQGLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWRQGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 24927 - protein, 248 aa, Homo sapiens [sequence omitted]

SEQ ID NO: 24928 - protein, 669 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 24929 - protein, 424 aa, Blastocladiella emersonii
TLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 24930 - protein, 199 aa, Homo sapiens [sequence omitted]

SEQ ID NO: 24931 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRRSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 24932 - protein, 324 aa, Rana temporaria
MTLTKETRVTLNDGNMMPILGLGTYASPHVPKSLAEEAVKIAIDVGYRHIDCAFITGNEMHIGNGIRSKISDGTVKREDIFYTGKLWCTYFSPEMVRKGLERSLRDVGMDYLDLFLMHWPVSLKPSGASDPSDKDKPFIYDNVDLCATWEALEARKDAGLVRSLGVSNFNRRQLERILNKPGLKYKPVCNQVECHVYLNQNKLHSYCKSKDIVLVTYSVLGSHRDRNWVDLSLPVLLDDPILNKVAAKYNRTSAEIAMRFILQKQIVVLAKSFTPARIKQNLGVFEFELKPEDMKSLESLDRNLHYGPFREVKQHPEYPFHDEY

SEQ ID NO: 24933 - protein, 282 aa, Marchantia polymorpha
QLTESDIMIPIESFEEPWVLFRGKDGRAGCVRDECAHRACPLSLGTVVDGRIQCPYHGWEYNTGGKCEKMPSTRPLKTGIRALPCIEQDGMVWIWPGDETPAATLPSLLPPENYTIHAEIVLELPVEHGLLMENLLDLAHAPFTHTSTFAKGWSVPNMVKFKTPMQALSGNWDPYPIDMAFQPPCMVLSTIGLVKPGKLDGSSTASCSKHLHQLHVCMPSSRGKTRLMYRWLWTLPNGRSMPYIDRVWTHLANQVLNEDLRLVEGQQDRMKRGANVWQTPVG

SEQ ID NO: 24934 - protein, 463 aa, Dunaliella salina
MQSKLLGLQDEISEARDKLRTSEARVAQNLKRVDELKAEAASLERMRLASSSSTDSTVSIASRGGAAVAATTSVPDHVEREGIQSRVRGSGMASTSYPSHVPQPSQAVRRGPKPKDSRRLRSSLELEDGLRNFWYPTEFAKKLEPGMMVPFDLFGVPWVLFRDEHSAPTCIKDSCAHRACPLSLGKVINGHVQCPYHGWEFDGSGACTKMPSTRMCHGVGVAALPCVEKDGFVWVWPGDGPPPDLPPDFTAPPAGYDVHAEIMVDVPVEHGLLMENLLDLAHAPFTHTTTFARGWPIPEAVRFHATKMLAGDWDPYPISMSFNPPCIALSTIGLSQPGKIMRGYKAEECKRHLHQLHVCMPSKEGHTRLLYRMSLDFWGWAKHVPFVDVLWKKIAGQVLGEDLVLVLGQQARMIGGDDTWCTPMPYDKLAVRYRRWRNMVADGEYEEGSRNRCTSQYDSWPDV

SEQ ID NO: 24935 - protein, 276 aa, Prochlorothrix hollandica
LDLGMADPLGFELFDQCWVLFRDDQGTAACILDECAHRACPLSLGKVIQGRIQCPYHGWEYDRQGECVHMPSCQAISNPILTLPVMEQGGMIWVWPGTDEPGALPSLAPTLPDNFTLQAELVMDLEVEHGLMLENLLDLAHAPFTHTGTFAKGWPVPPFVRFANAATTPWTGHWDPYPIHMTFEPPCFVISTIGLRGKDCGRHLHQVHACLPRGQGRTRLLYRLALDFGHWLRWVPGTHCLWQHLANRVIQEDLRLVQGQQERLKGGANVWNQPVG

SEQ ID NO: 24936 - protein, 276 aa, Prochloron didemni
QNVNTTTPMPFELFDRSWILFRDRNSNIGCIHDRCAHRACTLSLGKVVNGRVQCAYHGWEYNTEGTCEVMPSCKQTKAAVKALPAIEQSGMIWVWPGSGVPGELPKLAPAIPENFTLQAEITMELDVEHGLFMENLLDLAHAPFTHTGTFAKGWPVPDFVRFANLPKTPLTGHWDPYPIDMSFEPPCYVISTIGLRGRDCGRHLHQVHVCLPKGKGKTRLLYRLALDFYKWLRFVPGMNLFWEHMAQRVIGEDIRLVRGQQKSLQEGGNVWNQPVG

SEQ ID NO: 24937 - protein, 759 aa, Oncorhynchus mykiss
MPAFSCAFPGCRRDLLVIVLVVFVGIGLPIEASAPAYQSHGTEGSHLTNITNTKKAFPVLAVNYEHVRKPFEIALWILLALLMKLGFHLIPRLSAVVPESCLLIVVGLLVGGLIKVIGEEPPVLDSQLFFLCLLPPIILDAGYFLPIRPFTENVGTILVFAVIGTLWNAFFMGGLLYALCQIESVGLSGVDLLACLLFGSIVSAVDPVAVLAVFEEIHINELVHILVFGESLLNDAVTVVLYNLFEEFSKVGTVTVLDVFLGVVCFFVVSLGGVLVGAIYGFLAAFTSRFTSHTRVIEPLFVFLYSYMAYLSSEMFHLSGIMALIACGVVMRPYVEANISHKSYTTIKYFLKMWSSVSETLIFIFLGVSTVAGPHAWNWTFVITTVILCLVSRVLGVIGLTFIINKFRIVKLTKKDQFIVAYGGLRGAIAFSLGYLLSNSHQMRNLFLTAIITVIFFTVFVQGMTIRPLVELLAVKKKKESKPSINEEIHTEFLDHLLTGVEGVCGHYGHYHWKEKLNRFNKTYVKRWLIAGENFKEPELIAFYRKMELKQAIMMVESGQLPSVLPSTISMQNIQPRAIPRVSKKREEEIRRILRANLQNNKQKMRSRSYSRHTLFDADEEDNVSEVRLRKTKMEMERRVSVMERRMSHYLTVPANRESPRPGVRRVRFESDNQVFSADSFPTVHFEQPSPPSTPDAVSLEEEEEEVPKRPSLKADIEGPRGNASDNHQGELDYQRLARCLSDPGPNKDKEDDDPFMSC

SEQ ID NO: 24938 - protein, 327 aa, Acholeplasma laidlawii
MAIITLLEAINQAIDQAMEKDESIVVFGEDAGFEGGVFRVTAGLQKKYGETRVFDTPIAESAIVGSAVGMAINGLKPIAEIQFDGFIFPGYTDLVTHAARMRNRSRGQFTVPMVLRLPHGGGIRALEHHSEALEVLFGSIPGLKVVTPSTPYDAKGLLLAAINDPDPVVFLEPKRIYRAGKQEVPAEMYEIPIGKAKVVKQGTDMTVVAWGSIVREVEKAVKLVEAEGISVEIIDLRTISPIDEETILNSVKKTGKFMVVTEAVKSYGPAAELITMVNEKAFFHLEAAPVRFTGFDITVPLARGEHYHFPQPEKIAAYIRKLAKARP

SEQ ID NO: 24939 - protein, 707 aa, Oryctolagus cuniculus
MGMSKSLSCFGYPLSIFFIVVNEFCERFSYYGMRALLILYFRNFIGWDDNLSTVIYHTFVALCYLTPILGALIADAWLGKFKTIVWLSIVYTIGQAVTSLSSVNELTDNNHDGTPDSLPVHVAVCMIGLLLIALGTGGIKPCVSAFGGDQFEEGQEKQRNRFFSIFYLAINAGSLLSTIITPMVRVQQCGIHVKQACYPLAFGIPAILMAVSLIVFIIGSGMYKKFKPQGNILSKVVKCICFAIKNRFRHRSKQFPKRAHWLDWAKEKYDERLIAQIKMVTRVLFLYIPLPMFWALFDQQGSRWTLQATTMSGRIGILEIQPDQMQTVNTILIIILVPIMDAVVYPLIAKCGLNFTSLKKMTIGMFLASMAFVAAAILQVEIDKTLPVFPKANEVQIKVLNVGSENMIISLPGQTVTLNQMSQTNEFMTFNEDTLTSINITSGSQVTMITPSLEAGQRHTLLVWAPNNYRVVNDGLTQKSDKGENGIRFVNTYSQPINVTMSGKVYEHIASYNASEYQFFTSGVKGFTVSSAGISEQCRRDFESPYLEFGSAYTYLITSQATGCPQVTEFEDIPPNTMNMAWQIPQYFLITSGEVVFSITGLEFSYSQAPSNMKSVLQAGWLLTVAVGNIIVLIVAGAGQINKQWAEYILFAALLLVVCVIFAIMARFYTYVNPAEIEAQFEEDEKKKNPEKNDLYPSLAPVSQTQM

SEQ ID NO: 24940 - protein, 525 aa, Spinacia oleracea
MAGRNIKNGENNKIAGSSLHLEKNPTTPPEAEATLKKLGLVASVAAGVQFGWALQLSLLTPYVQLLGIPHTWAAYIWLCGPISGMIVQPLVGYYSDRCTSRFGRRRPFIAAGAALVAVAVGLIGFAADIGAASGDPTGNVAKPRAIAVFVVGFWILDVANNTLQGPCRALLADMAAGSQTKTRYANAFFSFFMALGNIGGYAAGSYSRLYTVFPFTKTAACDVYCANLKSCFFISITLLIVLTILALSVVKERQITIDEIQEEEDLKNRNNSSGCARLPFFGQLIGALKDLPKPMLILLLVTALNWIAWFPFLLFDTDWMGKEVYGGTVGEGKLYDQGVHAGALGLMINSVVLGVMSLSIEGLARMVGGAKRLWGIVNIILAVCLAMTVLVTKSAEHFRDSHHIMGSAVPPPPPAGVKGGALAIFAVLGIPLAITFSIPFALASIFSASSGSGQGLSLGVLNLAIVVPQMFVSVTSGPWDAMFGGGNLPAFVVGAVAATASAVLSFTLLPSPPPEAKIGGSMGGH

SEQ ID NO: 24941 - protein, 484 aa, Agrobacterium tumefaciens
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPVVLIGPLIDQEAVPKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSDLGREGSHYGIDEYLEIKYLCSAIG

SEQ ID NO: 24942 - protein, 191 aa, Drosophila melanogaster
RKAMKSVTETGVELSNEERNLLSVAYKNVVGARRSSWRVISSIEQKTEASARKQQIAREYRERVEKELREICYEVLGLLDKYLIPKASNPESKVFYLKMKGDYYRYLAGYVDNGNMKVCIGTKSRLSVPSNKEHHYRNLRDRYTNCTYVDGNLKLTWLPNENLDLSFLDNIREVTGYILISHVDVKKVVFP

SEQ ID NO: 24943 - protein, 31 aa, Mirounga leonina
KVKRITPRHLQLAIRGDEELDSLIKATIAGG

SEQ ID NO: 24944 - protein, 630 aa, Hordeum vulgare subsp. vulgare
  unsure (1)..(630): unsure at all Xaa locations
MSKFLAIGLLLLHLINHGIYLVKAWDDKDFFKYCPPSQCSQHGPEIRFPFCLESSNKSSSSSSSSSCGCDGRSIRKLACSGQDTILVHPFLGPYSVSAIDYRHSSMKVIPLVDPCLMLNQNLIISRNSSSLQIDVINVYKTKFDRDFFWPSYAAVVRCSREFSPGADDRIVGPVSCLSNATHFFYFVASYADMSILPLDCKAAPLSHGVSGSLIPMYWSCSPYNLGSFKEGAETFLSSAETTVCWLGSECRKCEIIGGRCAFSSERNLAFCMPGGSRIKVIAATSSVAAFVVLLLTVAIVLYLSLKTRYNAEIHLKVEMFLKTYGTSKPTRYTFFEVKKMARRFKEKVGQGGFGSVYKGELPNGVPVAVKMLENSRGEGEVFINEVATIGLIHHANIVRLLGFCSEGMRRALIYEFMPNESLEKYIFSDDPNIFQNLLVPDKLVDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRDSDPSIESQSDVYLPEWIYEKVINGEELALTLGATQGEKEKVTQLAMVALWCIQWXPRNRPSMTKVLXMLTGRLQTCRCHQSRS

SEQ ID NO: 24945 - protein, 496 aa, Mentha spicata
MELDLLSAIIILVATYIVSLLINQWRKSKSQQNLPPSPPKLPVIGHLHFLWGGLPQHVFRSIAQKYGPVAHVQLGEVYSVVLSSAEAAKQAMKVLDPNFADRFDGIGSRTMWYDKDDIIFSPYNDHWRQMRRICVTELLSPKNVRSFGYIRQEEIERLIRLLGSSGGAPVDVTEEVSKMSCVVVCRAAFGSVLKDQGSLAELVKESLALASGFELADLYPSSWLLNLLSLNKYRLQRMRRRLDHILDGFLEEHREKKSGEFGGEDIVDVLFRMQKGSDIKIPITSNCIKGFIFDTFSAGAETSSTTISWALSELMRNPAKMAKVQAEVREALKGKTVVDLSEVQELKYLRSVLKETLRLHPPFPLIPRQSREECEVNGYTIPAKTRIFINVWAIGRDPQYWEDPDTFRPERFDEVSRDFMGNDFEFIPFGAGRRICPGLHFGLANVEIPLAQLLYHFDWKLPQGMTDADLDMTETPGLSGPKKKNVCLVPTLYKSP

SEQ ID NO: 24946 - protein, 500 aa, Mentha x piperita
MELQISSAIIILVVTYTISLLIIKQWRKPKPQENLPPGPPKLPLIGHLHLLWGKLPQHALASVAKQYGPVAHVQLGEVFSVVLSSREATKEAMKLVDPACADRFESIGTKIMWYDNDDIIFSPYSVHWRQMRKICVSELLSARNVRSFGFIRQDEVSRLLGHLRSSAAAGEAVDLTERIATLTCSIICRAAFGSVIRDHEELVELVKDALSMASGFELADMFPSSKLLNLLCWNKSKLWRMRRRVDAILEAIVEEHKLKKSGEFGGEDIIDVLFRMQKDSQIKVPITTNAIKAFIFDTFSAGTETSSTTTLWVMAELMRNPEVMAKAQAEVRAALKGKTDWDVDDVQELKYMKSVVKETMRMHPPIPLIPRSCREECEVNGYTIPNKARIMINVWSMGRNPLYWEKPETFWPERFDQVSRDFMGNDFEFIPFGAGRRICPGLNFGLANVEVPLAQLLYHFDWKLAEGMNPSDMDMSEAEGLTGIRKNNLLLVPTPYDPSS

SEQ ID NO: 24947 - protein, 293 aa, Zea mays subsp. mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFSNYKPRTDLPNVVELYMKKELEVEKFITHSVPFAEINKAFDLMA

SEQ ID NO: 24948 - protein, 293 aa, Zea mays subsp. mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 24949 - protein, 214 aa, synthetic construct
MAPMKLYGAVMSWNVTRCATALEEAGSDYEIVPINFATAEHKSPEHLVRNPFGQVPALQDGDLYLFESRAICKYAARKNKPELLREGNLEEAAMVDVWIEVEANQYTAALNPILFQVLISPMLGGTTDQKVVDENLEKLKKVLEVYEARLTKCKYLAGDFLSLADLNHVSVTLCLFATPYASVLDAYPHVKAWWSGLMERPSVQKVAALMKPSA

SEQ ID NO: 24950 - protein, 306 aa, Homo sapiens
VLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 24951 - protein, 321 aa, Homo sapiens
PKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKRTPALIALRYQLQRGVVVLAKSYNEQRIRENIQVFEFQLTSEDMKVLDGLNRNYRYVVMDFLMDHPDYPFSDEY

SEQ ID NO: 24952 - protein, 352 aa, Schizophyllum commune
MGGCASKPVDLEAKARSDDIDKMIEEDGKRLKKECKILLLGSGESGKSTIVKQMKIIHQDGFSQDELIAFRPSSTANVLDSAKAILSHEKLNVECEDFKNRPLQDKILDYQLDETNLPFPRHLPNHKPFWKDPAVTRIIDEQTSHFYLMDSATYFFTEVLRIGEPNYIPTETDVLRARAKTTSITETRFTMGPLSIHMFDVGGQRSERKKWIHCFESVTSIIFCTALSEYDQSLLEEKNQNRMAESLVLFESIINSRWFLRTSIIIFLNKIDVFKLKVHKVPLERYFPEYTGGKDPNKAAKFILWKFMQANRAGLSVYPHLTQATDTSNIRLVFAAVKETILQNALKDSGIL

SEQ ID NO: 24953 - protein, 352 aa, Suillus bovinus
MGNCVSAQDREEKARSDAIDRQIEEDSRKFRKECKILLLGSGESGKSTIVKQMKIIHQNGFNENELMTFRPTIYRNTLDSAQAIVLQMRNMNVECATPANRTFAERIVEYRVENTPDFVFSADIAQAIHELWQDPIIPKVMDCSSQFYLMDSAGYFFTEVLRIGTPDYIPTENDVLRARAKTTGITETRFNMGQLSIHMFDVGGQRSERKKWIHCFESVTSIIFCTALSEYDQVLLEEKNQNRMQESLILFESASTPAGLRTSIILFLNKIDVFKNKLPKVPIEKYFPEYTGGADINKAAKYILWKFMQANRARLSVYPHLTQATDTTNIRLVFAAVKETILQNALKDSGIL

SEQ ID NO: 24954 - protein, 352 aa, Spironucleus vortens
LELRDGGADYAGKGVEKALNNIRTIIAPALIGMDVTNQVAIDKKLEEIDGTENKTFKKIGANAALPVSMACCVAAAAFKKMPLWKYISEISGQSPSLPVPCLNIINGGKHAGNMLAPQEYMVAPYKATSMHEAMKWGMEVYACLQKGLKKTFGIGSTAVGDEGGFAPQVNDPEEPLKLIMQAITDAKLEGKIGICMDVAASEFFCEKEKKYNLKFKNTDGQTNWKTGAEMVDLYMSFIQKYPIVSIEDPFDQDDFESYALLLQKIKAGNHKTQVVGDDLTVSQVSRVQMAIDKKACNALLLKVNQVGTVMGAINAAKLAFSDKWHTMVSHRSGETEDVFISHLVVGLGTMQI

SEQ ID NO: 24955 - protein, 353 aa, Hexamita inflata
LELRDDDNSKYFGKGVQKALDNIKNIIAPALIGMDVCNQKAIDEKMQALDGTENRTFKKLGANAVLPVSMACAVAASKFKKIPLWKYISEISNTKHNLPVPCMNIINGGKHAGNLLAPQEYMIAPIAATSMVQAMQWGMEVYNELKKQLKKNFGIGAIAVGDEGGFAPNINDTEEPLKQIVSAINAAGLEGKMGICMDVAASEFYDDKQKAYNLKFKHDNGESQFLTGEELGNLYLSFIEKYPIVSIEDPFDQDDFKSYAQLLSNIKSRNLKCQVVGDDLTVSQASRVSMAIDNKACNALLLKVNQVGTVSGAIEAAKLSQADNWKVMVSHRSGETEDVFISHLVVGLGTQQI

SEQ ID NO: 24956 - protein, 353 aa, Hexamita inflata
LELRDDDNSKYFGKGVQKALDNIKNIIAPALIGMDMCNQRAIDEKMQALDGTENRTFKKLGANAVLPVSMACAVAAAKFKKIPLWKYISEISNTKHNLPVPCMNIINGGKHAGNLLAPQEYMIAPIAATSMVQAMQWGMEVYNELKKQLKKNFGIGAIAVGDEGGFAPNVNDTEEPLKQIVSAINAVGLEGKMGICMDVAASEFYDDKQKAYNLKFKHDNGESQFLTGEELGNLYLSFIEKYPIVSIEDPFDQDDFKSYAQLLSNIKSRNLKCQVVGDDLTVSQASRVSMAIDNKACNALLLKVNQVGTVSGAIEAAKLSQADNWKVMVSHRSGETEDVFISHLVVGLGTQQI

SEQ ID NO: 24957 - protein, 329 aa, Trichomitus batrachorum
VYAKQFGEVVFAGRSSAPSGASTGSGEAQELRDKDLPRYGGKGTQKAASNVAEFISPAIRGMTFADLSALDGAICQADGTTLKTKIGGNACTAASFALAESAASLLHLQLFQYLAQQFHQAALPPKFRLPTPFFNILNGGKHAGGKLKVQEFMISPREDAPFPEQLRMADEVYMHLGAILAKEKGVSAKNLGDEGGFAPLLDTPEEALSYIEKAIVEAGLKVGEDIRLGLDAAASEFYDKTTKTYEIEEGVVKTGEEMIQYWAALVEKHPAVVSIEDGLDEQDYENWVKLNEALGSKIQLVGDDLYTTNPATIRKGLEGKWCNALLLKV

SEQ ID NO: 24958 - protein, 330 aa, Trichomitus batrachorum
VYADYLGQVIFAGRSSAPSGASTGVGEAYELRDGDAKRFGGKGTLTASGNVAKLLSPALKGMCFCDLKALDKKICDTDGTPLKKNVGGNACTATSFALAESAANLCGCQLFEYLAKQYHGAEKVPKKFKLPTPFFNILNGGKHAGGNLKLQEFMASPKPGIPFPDQLRMVAEVYQKLGALLVKTKGVSAKNLGDEGGFAPLIDNPEEAITLIEQAMREAGYEPGVDMFLGLDAAASEFYDKDKKLYEVEVGKFLTAEQMIDYWDQMCTRHKCLVSIEDGLDELDYENWTKMNEKIGKKVQLVGDDLYTTNPSTIRKGLAGKWCNALLLKV

SEQ ID NO: 24959 - protein, 330 aa, Monocercomonas ATCC50210
VYATQYGQVNLAGRSSAPSGASTGSNEARELRDTDRPRYGGKGTLQASENVSTILSPALHGMSFADLNALDEAIRNADGTELKEKVGGNACTAASFALAEAAAALNGEELFLYLARQFYKNGEVPTKFKLPTPFFNILNGGKHAGGNLKIQEFMISPNTEIPFPDQLRMAAEIYHKLGAILAQEKGVSAKNLGDEGGYAPLLNTPEEAIEFIERAIKDAGYTPGTDIRLGLDAAASEFYNQETKTYEVEVGVQKTGEEMIQYWQDLVTRHPSIYSIEDGLDEKDYENWIKLNAAIGDKVQLVGDDLYTTNPKTIRAGLEGKWCNALLLKV

SEQ ID NO: 24960 - protein, 330 aa, Monocercomonas ATCC50210
VYANYCGEVVFAGRSSAPSGASTGSNEARELRDNDPKRYNGKGTLQAAQNVTELITPAVKNLVLNNIHDLDRAIRRVDKPELKEKIGGNATTATSFAFATAGANMNGEELFQYLARQIYPEESIPTKFKLPTPFFNILNGGKHAGGNLKLQEFMVSPAENIPFPDQLRMVAEVYQKLGGILSKQFGVSAKNLGDEGGFAPLINSPDEALTVIEQAITEAGYKPGEEIRIGLDAAASEFYDKETKLYEVEVGMKKNGDELIQYWADMIEHHPSIVSVEDALDEKDYAHWIKLNKELGSKVQLVGDDLYTTNPNTIKKGLEGNWCNALLLKV

SEQ ID NO: 24961 - protein, 331 aa, Trichomonas vaginalis
VYVKYLGRITLAGRSSAPSGASTGVGEALELRDGDKARYGGKGTQKAAKNVTEVLSPALKGMCFCDFPALDKKICDTDGTVLKKNIGGNACTATSFALAEAGAAVQEIELFQYLAKAFYGGCDKVPKKFKLPSPFFNILNGGKHAGGNLKFQEFMVTPTRKVPFPDQLRMVAEVYQKLGGLLVKKYGLSAKNLGDEGGFAPNLNDPEEALTVIEEAIKAAGYEAGKDIMIGMDVASSEFYDENKKLYEVEVGKFLTADQMIDYFDELLKKHPAIVSIEDALAELDYENWTKLNARLGQRVQLVGDDLYTTNPITIKKGLEGKWCNALLLKV

SEQ ID NO: 24962 - protein, 331 aa, Trichomonas vaginalis
VYVKYLGRITLAGRSSAPSGASTGVGEALELRDGDKARYGGKGTQKAAKNVTEVLSPALKGMCFCDFPALDKKICDTDGTVLKKNVGGNACTATSFALAEAGAAIQEIELFQYLAKAFYGGCDKVPKKFKLPSPFFNILNGGKHAGGNLKFQEFMVTPTRKVPFPDQLRMIAEVYQKLGGILVKKYGLSAKNLGDEGGFAPNLDSPEEALVVIEEAIKAAGYEAGKDVFIAMDVASSEFYDEEKKLYEVEVGKFLNADQMIEYYEDLLKRHPAIVSIEDALGELDYENWTKLNAKIGDKVQLVGDDLYTTNPITIKKGLEGKWCNALLLKV

SEQ ID NO: 24963 - protein, 331 aa, Trichomonas vaginalis
VYVKYLGRVTLAACSSAPSGASTGVGEALELRDGDKARYGGKGTQQAAKIVTEMLSPALKGMCFCDFPALDKKICDTDGTVLKKNIGGNACTATSFALAEAGAAVQEIELFQYLAKAFYGGCDKVPKKFKLPSPFFNILNGGKHAGGNLKFQEFMVTPTRKVPFPDQLRMVAEVYQKLGGLLVKKYGLSAKNLGDEGGFAPNLNDPEEALTVIEEAIKAAGYEAGKDIMIGMDVASSEFYDENKKLYEVEVGKFLTADQMIDYFDELLKKHPAIVSIEDALAELDYENWTKLNARLGQRVQLVGDDLYTTNPITIKKGLEGKWCNALLLKV

SEQ ID NO: 24964 - protein, 331 aa, Trichomonas vaginalis
VYVKYLGRITLAARSSAPSGASTGVGEALELRDGDKARYGGKGTLKAAANVTEKLSPALKGMCFCDLPALDKKICDTDGTVLKKNIGGNACTATSFALAEAGAAIQEIQLFEYLAKAFYGGADKVPKKFKLPSPFFNILNGGKHAGGNLKFQEFMVTPTRKVPFPDQLRMVAEVYQKLGGLLVKKYGLSAKNLGDEGGFAPNLNDPEEALSVIEEAIKAAGYEAGKDIMIGMDVASSEFYDEEKKLYEVEVGKFLNADQMIDYFDDLLKRHPAIVSIEDALAELDYENWTKLNARLGQRVQLVGDDLYTTNPITIKKGLEGKWCDALLLKV

SEQ ID NO: 24965 - protein, 331 aa, Trichomonas vaginalis
VYVKYLGRITLAGRSSAPSGASTGVGEALELRDGDKARYGGKGTLKAAKNVTEVLSPALKGMCFCDFPALDKKICDTDGTVLKKNVGGNACTATSFALAEAGAAIQEIELFQYLAKAFYGGCDKVPKKFKLPSPFFNILNGGKHAGGNLKFQEFMVTPTRKVPFPDQLRMIAEVYQKLGGILVKKYGLSAKNLGDEGGFAPNLDSPEEALVVIEEAIKAAGYEAGKDVFIAMDVASSEFYDEEKKLYEVEVGKFLNADQMIEYYEDLLKRHPAIVSIEDALGELDYENWTKLNAKIGDKVQLVGDDLYTTNPITIKKGLEGKWCNALLLKV

SEQ ID NO: 24966 - protein, 370 aa, Trypanosoma brucei
VTTERGVFRSAVPSGASTGVYEACELRDGDKKRYVGKGCLQAVKNVNEVIGPALIGRDELKQEELDTLMLRLDGTPNKGKLGANAILGCSMAISKAAAAAKGVPLYRYLASLAGTKELRLPVPCFNVINGGKHAGNALPFQEFMIAPVNATSFSEALRMGSEVYHSLRSIIKKKYGQDAVNVGDEGGFAPPIKDINEPLPILMEAIEEAGHRGKFAICMDCAASETYDEKKQQYNLTFKSPEPTWVTAEQLRETYCKWAHDYPIVSIEDPYDQDDFAGFAGITEALKGKTQIVGDDLTVTNTERIKMAIEKKACNSLLLKINQIGTISEAIASSKLCMENGWSVMVSHRSGETEDTYIADLVVALGSGQI

SEQ ID NO: 24967 - protein, 347 aa, Trypanosoma cruzi
CELRDDDKRRYLGKGCLNAVKNVNDVLAPALVGKDELQQSTLDKLMRDLDGTPNKSKLGANAILGCSMAISKAAAARKGVPLYRYLAELAGTKEVRLPVPCFNVINGGKHAGNALPFQEFMIAPVKAGSFNEALRMGAEVYHSLKSIIKKKYGQDAVNVGDEGGFAPPITDINEPLPILMEAIEQAGHKGRFAICMDSAASETYDENKKQYNLTFKSPEATWVTAKQLAETYAKWVSEYPIVSLEDPYDQDDFDGFAGITETLKGKAQVVGDDLTVTNVSRIKMAIEKKACNSLLLKINQIGTITEAIEASKFCMSNGWSVMVSHRSGETEDTYIADLVVGLGTGQI

SEQ ID NO: 24968 - protein, 347 aa, Trypanosoma cruzi
CELRDDDKRRYLGKGCLNAVKNVNDVLAPALVGKDELQQSTLDKLMRDLDGTPNKSKLGANAILGCSMAISKAAAARKGVPLYRYLAELAGTKEVRLPVPCFNVINGGKHAGNALPFQEFMIAPVKAGSFNEALRMGAEVYHSLKSIIKKKYGQDAVNVGDEGGFAPPITDINEPLPILMEAIEQAGHKGRFAICMDSAASETYDENKKQYNLTFKSPEATWVTAKQLAETYAKWVSEYPIVSLEDPYDQDDFDGFAGITEALKGKAQVVGDDLTVTNVSRIKTAIEKKACDSLLLKINQIGTITEAIEASKFCMSNGWSVMVSHRSGETEDTYIADLVVGLGTGQI

SEQ ID NO: 24969 - protein, 178 aa, Rosa hybrid cultivar
ECAFWMPSRTGLNLQLSHTLTQVSSGANVSINLPIVTEVFNSARALRIPYTCPLARFRPLVGRYMSPEVVAVRVPLLNLSNFQINDWPELSAKSYAIMVLILPTDSARQWREHELELVEVVADQVAVALSHAAILEESMRARDQLMEQNVALDLARREAEMAIHARNDFLAVMNHEMR

SEQ ID NO: 24970 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMTKTLKPRAVTGFVIGFWILDVANNMLQGPCRALLADLCNGDTRRMRSANAFYSFFMAVGNILGYAAGSYNNLYKLFPFSKTHACDLYCANLKSCFIISIVLLIFITVLALTVVREKQWSPDEADEEPPSSGKIPVFGELFGALKDLPRPMLMLLVVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPSKDAAAKLTLSGPYH

SEQ ID NO: 24971 - protein, 266 aa, Sphingomonas sp.
MSNRLDGQVALLTGGATGIGAAVVARYIEEGAKVGVLVKDDEQVELVRSRHGDSVVAVAGDVRSYADNARAVAETVAAFGKLDVFVGNVGIWDFMVPLEQQDPEQLGKVFDEIFDVNLKGYFFGARAAIPELRKVKGSIIFTASTSSYYTGGGGTLYVASKHAVLGLIKQLAWELAPEIRVNGVAPGGTRTPLSGTQTGGFAEMKMEQMPGLDEMISSMTPLGRIAEPADHAGLYALLASRRDSSYLTGTMLLSDGGSGIGNRPDG

SEQ ID NO: 24972 - protein, 499 aa, Sphingomonas sp.
MATQLKSGTNEYGIKSEYGHFIGGEWISSDSGKTIDLINPATGAVLTKIQAGNAKDIQRAVAAAKAAFPKWADSSAAERQEILIEVARRLKARHQHYATLETLNNGKPIRESMHFDMPQAIGQFELFAGAAYGLHGQTMDYPDAVGIVHREPLGVCAQIIPWNVPMLMMACKIAPALASGNTVVLKPAETVCLSVIEFFVEMADLLPPGVINVVTGYGADVGEALVTHEDVRKVAFTGSVGTARRIMQYASTNIIPQTLELGGKSAHIVCADADIDAAVESATMSTVLNKGEVCLAGSRLFLHESIQDEFLAKFKVALEGIRQGDPLDFATQLGAQASQMQMDKVISYLELATEEGANVLTGGSANDKLADGNFIRPTVFTNVNNSMRIAREEIFGPVTSVISWKDEDDMMKVANDTNYGLAGGIWTRDIARAHRMARKLETGTVWINRYYNLKANMPLGGYKQSGFGREFSHEVLNHYTQTKSVVVNLQEGRTGMFDQ

SEQ ID NO: 24973 - protein, 318 aa, Lycopersicon pimpinellifolium
MGSKYSKATNSINDASNLSYGVPFENYRVPFVDLEEATNNFDDNFFIGEGGFGKVYRGVLRDGTKVALKKHKPESSQGIEEFETEIEILSFCSHPHLVSLIGFCDERNEMILIYDYMENGNLKSHLYGSDLPSMSWEQRLEICIGAARGLHYLHKNAVIHRDVKCTNILLDENFVPKITDFGISKTMPELDQTHLSTVVRGNIGYIAPEYALWGQLTEKSDVYSFGVVLFEVLCARPALDRSEIMSLDDETQKMGQLEQIVDPTIAAKIRPESLRMFGETAIKCLAPSSKNRPSMGDVLWKLEYALCLQEPTIQDDPE

SEQ ID NO: 24974 - protein, 345 aa, Pisum sativum
MVVPSPTSMIRTKKTKAVGIPTIDLSLERSQLSELVVKACEEYGFFKVVNHSVPKEVISRLDEEGIEFFSKNSSEKRQAGTSTPFGYGCKNIGPNGDKGELEYLLLHSNPISISERSKTIAKDHPIKFSCIVNDYIKAVKDLTCEILELAAEGLWVPDKSSLSKIIKDEHSDSLLRINHYPPVKKLGNDNWDPSKIQNSNNNNIGFGEHSDPQILTILRSNNVGGLQISTHHGLWIPVPPDPSEFYVMVGDALQVLTNGRFVSVRHRVLTNTTKPRMSMMYFAAPPLNWLISPLSKMVTAHSPCLYRPFTWAQYKQAAYALRLGDTRLDQFKVQKQEDSNDSHSL

SEQ ID NO: 24975 - protein, 322 aa, Pisum sativum
KPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQEHNFSLYGEDIDKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKSVRHRVLANGIDPRLSMIYFCGPPLSEKIAPLPSLMKGKESLYKEFTWFEYKSSTYGSRLADNRLGNYERIAAT

SEQ ID NO: 24976 - protein, 509 aa, Drosophila melanogaster
MATTTTTTTTTGATNAKDGVTMREKKGGALQKLKKRLSHSFGRLTISREDGDESTHHHHHHHHHRGGHGGHHNHGNKVPYNGYNSEEYLDRLEPNGNIPADKTNCRYGDWRSTDSTDHHDRVQRQLSVSSDSKLLDEDIREEMKYHSHVVMRPKKPPRPKSEVFLNKQETHPRRKRFSAFGGDSPFGKQEAYVKLEPLGEGSYATVYKGFSKLTYQRVALKEIRLQEEEGAPFTAIREASLLKELKHSNIVTLHDIVHTRETLTFVFEYVNTDLSQYMEKHPGGLDHRNVRLFLFQLLRGLSYCHKRRVLHRDVKPQNLLISDCGELKLADFGLARAKSVPSHTYSHEVVTLWYRPPDVLLGSTEYSTSLDMWGVGCIFVEMVTGMPTFPGIRDTYDQLDKIFKLLGTPTEDTWPGVTHFPGYKPHKLGFYRPRKLGHNFPRLYDIIEGETIANGFLQLNPEQRLGADDALQHPYFAQLPKKLYELPDETSIFTVEGVQLYTEPNRQNK

SEQ ID NO: 24977 - protein, 522 aa, Drosophila melanogaster
MAELISQPTKINNNNFGAGVTMREKKGGALQKLKKRLSHSFGRLTISREDGDESTHHHHHHHHHRGGHGGHHNHGNKVPYNGYNSEEYLDRLEPNGNIPADKTNCRYGAQESAKNDNNKPQDWRSTDSTDHHDRVQRQLSVSSDSKLLDEDIREEMKYHSHVVMRPKKPPRPKSEVFLNKQETHPRRKRFSAFGGDSPFGKQEAYVKLEPLGEGSYATVYKGFSKLTYQRVALKEIRLQEEEGAPFTAIREASLLKELKHSNIVTLHDIVHTRETLTFVFEYVNTDLSQYMEKHPGGLDHRNVRLFLFQLLRGLSYCHKRRVLHRDVKPQNLLISDCGELKLADFGLARAKSVPSHTYSHEVVTLWYRPPDVLLGSTEYSTSLDMWGVGCIFVEMVTGMPTFPGIRDTYDQLDKIFKLLGTPTEDTWPGVTHFPGYKPHKLGFYRPRKLGHNFPRLYDIIEGETIANGFLQLNPEQRLGADDALQHPYFAQLPKKLYELPDETSIFTVEGVQLYTEPNRQNK

SEQ ID NO: 24978 - protein, 501 aa, Drosophila melanogaster
MREKKGGALQKLKKRLSHSFGRLTISREDGDESTHHHHHHHHHRGGHGGHHNHGNKVPYNGYNSEEYLDRLEPNGNIPADKTNCRYGAQESAKNDNNKPQDWRSTDSTDHHDRVQRQLSVSSDSKLLDEDIREEMKYHSHVVMRPKKPPRPKSEVFLNKQETHPRRKRFSAFGGDSPFGKQEAYVKLEPLGEGSYATVYKGFSKLTYQRVALKEIRLQEEEGAPFTAIREASLLKELKHSNIVTLHDIVHTRETLTFVFEYVNTDLSQYMEKHPGGLDHRNVRLFLFQLLRGLSYCHKRRVLHRDVKPQNLLISDCGELKLADFGLARAKSVPSHTYSHEVVTLWYRPPDVLLGSTEYSTSLDMWGVGCIFVEMVTGMPTFPGIRDTYDQLDKIFKLLGTPTEDTWPGVTHFPGYKPHKLGFYRPRKLGHNFPRLYDIIEGETIANGFLQLNPEQRLGADDALQHPYFAQLPKKLYELPDETSIFTVEGVQLYTEPNRQNK

SEQ ID NO: 24979 - protein, 158 aa, Saccharomyces cerevisiae
MEEQEIGVPAASLAGIKHIILILSGKGGVGKSSVTTQTALTLCSMGFKVGVLDIDLTGPSLPRMFGLENESIYQGPEGWQPVKVETNSTGSLSVISLGFLLGDRGNSVIWRGPKKTSMIKQFISDVAWGELDYLLIDTPPGTSDEHISIAEELRYSKP

SEQ ID NO: 24980 - protein, 375 aa, Synechococcus sp. PCC 7002
MTQATNPVLDQTRNEGDIDYSALAEAQIKEGTDYVELTLPTKKSRKAKTSRRKETATKKKPYTEDSIRIYLQEIGRIRLLRAEEEIELARKIADLLELERMREQLTEHESRVPTDKEWAEAAGMPLKDFRRRLFHGRRAKDKMVQSNLRLVVSIAKKYMNRGLSFQDLIQEGSLGLIRAAEKFDHEKGYKFSTYATWWIRQAITRAIADQSRTIRLPVHLYETISRIKKTTKILSQELGRKPTEEEIAERMEMTIEKLRFIAKSAQLPISLETPIGKEEDSRLGDFIEADGETPEDQVSKSLLREDLENVLDTLSARERDVLRLRYGLDDGRMKTLEEIGQIFNVTRERIRQIEAKALRKLRHPNRNSILKEYIR

SEQ ID NO: 24981 - protein, 949 aa, Mesembryanthemum crystallinum
MASAFKGILIRSPPDVCAETVAKVSQCNRAQLVKNSSTGFKNIFKLSEARKFHAPVASHLRSQAVMAPASDPTSTAIKRVFTFGKGRSEGNKGMKSLLGGKGANLAEMASIGLSVPPGLTISTEACQEYQEHGKQLSAGLWEEILEGLRVIEKDMGSYLGDPSKPLLLSVRSGAAISMPGMMDTVLNLGLNDDVVAGLAAKSGERFAYDSYRRFLDMFGNVVMGISHSSFEEKLEKLKQVKGVKLDTELTASDLKEVVEQYKNVYLEVKGEKFPADPERQLQLAIQAVFDSWDSPRAIKYRNINQITGLKGTAVNIQCMVFGNMGNTSGTGVLFTRNPSTGEKKLYGEFLINAQGEDVVAGIRTPEDLDTMRSCMPEAYKELVENCEILERHYKDMMDIEFTVQENRLWMLQCRSGKRTGKGAVKIAVDLVKEGIVDTYTAIKMVEPQHLDQLLHPQFEDPSAYKDRVIATGLPASPGAAVGQIIFSADEAESWQAQGKSVILVRNETSPEDVGGMHAAIGILTARGGMTSHAAVVAGGWGKCCVSGCSEIRVNDTDKVLLVGDKVISEGDWLSLNGSTGESYLRESTTSPPALSGDLETFMSWADDIRVLKVMANADTPEDALAARNNGAEGIGLCRTEHMFFASDDRIKTVRKMIMAVTSEQRKVALDQLLPYQRSDFEGIFRAMDGLPVTIRLLDPPLHEFLPEGDVEQIVSELTLETGMAEDEIFSRIEKLSEVNPMLGFRGCRLGISYPELTEMQARAIFQAAVSMSNQGVKVFPEIMVPLVGTPQELGHQVSLIRNVAEKVFSETGSSLSYKVGTMIEIPRAALVADEIAMEAEFFSFGTNDLTQMTFGYSRDDVGKFLPVYLSKGILQSDPFEVLDQKGVGQLIKLATEKGRSARPSLKVGICGEHGGEPSSVAFFAEAGLDYVSCSPFRVPIARLAAAQVV

SEQ ID NO: 24982 - protein, 368 aa, Arabidopsis thaliana
MVDLSSLYNIHIPPLDSLLFAFSVSLSFVQSKRVCDSSLSSPWRDMNGDELPFESGFEVYAKGTHKSEFDSNLLDPRSDPIWDAIREEAKLEAEKEPILSSFLYAGILAHDCLEQALGFVLANRLQNPTLLATQLLDIFYGVMMHDKGIQSSIRHDLQAFKDRDPACLSYSSAILHLKGYHALQAYRVAHKLWNEGRKLLALALQSRISEVFGIDIHPAARIGEGILLDHGTGVVIGETAVIGNGVSILHGVTLGGTGKETGDRHPKIGEGALLGACVTILGNISIGAGAMVAAGSLVLKDVPSHSVVAGNPAKLIRVMEEQDPSLAMKHDATKEFFRHVADGYKGAQSNGPSLSAGDTEKGHTNSTS

SEQ ID NO: 24983 - protein, 524 aa, Rattus norvegicus
MPSVYGFPAFTSATELLLAVTTFCLGFWVVRVTRTWVPKGLKSPPGPWGLPFMGHVLTLGKNPHLSLTKLSQQYGDVLQIRIGSTPVVVLSGLNTIKQALVKQGDDFKGRPDLYSFTLIANGQSMTFNPDSGPLWAARRRLAQNALKSFSIASDPTLASSCYLEEHVSKEAEYLISKFQKLMAEVGHFDPFKYLVVSVANVICAICFGRRYDHDDQELLSIVNLSNEFGEVTGSGYPADFIPILRYLPNSSLDAFKDLNKKFYSFMKKLIKEHYRTFEKGHIRDITDSLIEHCQDRRLDENANVQLSDDKVITIVFDLFGAGFDTITTAISWSLMYLVTNPRIQRKIQEELDTVIGRDRQPRLSDRPQLPYLEAFILETFRHSSFVPFTIPHSTIRDTSLNGFYIPKGHCVFVNQWQVNHDQELWGDPNEFRPERFLTSSGTLDKHLSEKVILFGLGKRKCIGETIGRLEVFLFLAILLQQMEFNVSPGEKVDMTPAYGLTLKHARCEHFQVQMRSSGPQHLQA

SEQ ID NO: 24984 - protein, 495 aa, Rattus sp.
METTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 24985 - protein, 214 aa, Brassica napus
MTSFSTFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 24986 - protein, 249 aa, Fragaria x ananassa
MAYENKPNTDLDADAQRRLGRGKIEIKRIENTTNRQVTFCKRRNGLLKKAYELSVLCDAEVALIVFSNRGRLYEYSNNSSVRETIERYKKACADTSTNGSASEATTQYYQQEAAKLHNQINALQNINRGYMAEGLSNKNIKELKGMERKLERAITRIRSKKNELLFAEIEYMQKRELDLHNNNQLLRAKIAENERQQQSIIAITGGHGSYEIVQPTQPFHEARNYFQVNALQPNIHQYSCHDQVSLQLV

SEQ ID NO: 24987 - protein, 209 aa, Sus scrofa
KQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWILCFEGVTAIIFCVALSDYDLVLAEDEEMNRMHESMKLFDSICNNKWF

SEQ ID NO: 24988 - protein, 188 aa, Sus scrofa
GVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTH

SEQ ID NO: 24989 - protein, 133 aa, Sus scrofa
DSASYYLNDVDRISQTNYIPTQQDVLRTRVKTTGIVETHFTFKDLYFKMFDVGGQRSERKKWIHCFGGVTAIIFCVALSDYDLVLAEDEEMNRMHESMKLFDSIWYNKWFTDNSIILFLNQKDLFEEKIKRSP

SEQ ID NO: 24990 - protein, 355 aa, Cryphonectria parasitica
MGACMSSSSEETEQKKRSQKIDKDLEEDSKRLRRECKILLLGSGESGKSTIVKQMKIIHLKGYSDEELYNYRPTVFKNLIECAKAVVNAMRQFDIEPEKEETKTLCDFLLEYSVDSGPQVLIDTRVGEAIQAIWNDPARKQLMDRQTEFYLMDSAEYFFEQAQRIVRQDYLPNEMDVLRARTKTTGIYETRFQMGQLSIHMFDVGGQRSERKKWIHCFENVTSIIFCVALSEYDQVLLEESSQNRMMESLLLFDSVVNSRWFVRTSIILFLNKVDIFKQKLGRSPLSNYFPDYSGGNDVNKAAKYLLWRFNQVNRAHLNLYPHLTQATDTSNIRLVFAAVKETILNNALKDSGIL

SEQ ID NO: 24991 - protein, 504 aa, Escherichia coli
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFHWGPLPWATYSFLSVAFAYFFFVRKMEVIRPSSTLVPLVGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVMGLTASTWILWTVLGSNTLLLIDKNIINIPNLIEQYGVARAIIETWAALPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 24992 - protein, 437 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNDEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSYLIKFNQIGSLTETLAAIKMAKDAGYTAVISHRSGETEDATIADLAVGTAAGQIKTGSMSRSDRVAKYNQLIRIEEALGEKARTTVVKRSKARHKTDFI

SEQ ID NO: 24993 - protein, 262 aa, Betula pendula
IAAGVQFGWALQLSPLTPYVQLLGIPHTWAPFIWLCGPISGLFVQPVVGYYSDRCTSRFGRRRPFIAAGSSLVAIAVFLIGYAADLGHVFGDPIDKTTKTRAIAVFVLGFWILDVANNMLQGPCRALLADLSGDDQRRMRTGNALYSFFMAVGNVLGFAAGSYTRLYKLFPFTSTEACDVYCANLKSCFFLSIALLLILTTIALTAVKEQILSPQPEPGTAGGEEKQVVPFFGEIFFALKGLQRPMRILLMVTCLNWIAWFP

SEQ ID NO: 24994 - protein, 335 aa, Halocynthia roretzi
MAQHDDEVGKIFIGGLARQTEDDGLRAYFESFGEVVESIVMKDKVTGFSRGFGFVKFSDQQSVSKVLKNGPHSLDNKKIDPKPCTPKGIQQEKKSAAMEHTQSHKIFIGGIAQSSTTEDVKKYFEEGFGTVNEVVFVINKEDNRHKGFGFVTFANEQAVNKAVDMHFHEIGDKQIEAKRATPREKMPPRSHDNNQGMSNDAYGYGYGGQGPQGGGWMQGPAGANAMMGYGYGYGQGFPTSYPQGYGQGGYYGYGYNPGAYGGMGQMNKGDAGKGTNYSNMGSYQQTTSGYGPARANQSYGGGSDYNNGYGKNGGDASGGGGGGRSSSQGYHPYKR

SEQ ID NO: 24995 - protein, 231 aa, Hordeum vulgare subsp. vulgare
TVESVGEGVTDVAPGDHVLAVFTGECKECPHCKSAESNMCDLLRINTDRGVMNRDGKSRFFIGGKPIYHFVGTSTFSEYTVMHVGCVAKINPEAPLDKVCVLSCGISTGLGASINVAKPPKGSTVAIFGLGSVGLATAEGARIAGASRIIGIDLNAFRFEEARKFGCTEFVNPKAHTKPVQQVLADMTNGGVDRSVECTGNVNAMIQAFECVHDGWGVAVLVGVPHKDAEF

SEQ ID NO: 24996 - protein, 354 aa, Homo sapiens
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQGCFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 24997 - protein, 534 aa, Synechococcus sp. PCC 7002
MLGEMWSFNGRYKILHMTWFAFFLSFVVWFNFPPFATTIAQDFGLDKAQLGTIGLCNVALTVPARIIIGMLLDKYGPRLTYSLLLIYAAVPCLIFATAQSFNQLVLGRLLMGIVGAGFVIGIRMVAEWFPPKDVGTAEGIYGGWGNFGSAFSAFTMVIFGIILAFLPGAFNFGQPESFKILFFPEFNTAILNWRAAIAGTGIIAALYGMLYYFSVSDTPPGKTYHRPKSARGMEVTTKKDFWFLLAMNLPLTLILMVLAWRLQKVNFLNGTGFAIAILALVGLYLFQTYNCWTVNKDLMTGKKRYAPEDRYEFSQVAILELTYIVNFGSELAVVTMLPAFFEGTFSLDKATAGIIASSYAFMNLMSRPGGGLISDKMGSRKWTMVVLTVGMGVGYLLMSSVAGTWPLAIAVLLTMACSFFVQAAEGSTFAIVPLVKRRITGQIAGNVGAYGNVGAVAYLTVLLLLTEASAGANGGEPVMATVNAGFFQVLGITGLIVAFLCAFFLKEPKGSFAEFHEGETEMTATPPIEEEATY

SEQ ID NO: 24998 - protein, 283 aa, Pseudomonas fluorescens
LEFIINRMIGVHPKALLNYDGLPLEIKESVDKRIAGYNDPVGFYVEKLVEGISTLAAAFYPKKVIVRLSDFKSNEYANLIGGKLYEPEEENPMLGFRGASRYISEAFRDCFELECRALKRVRNEMGLTNVEIMVPFVRTLGEASQVVDLLAENGLSRGENGLRVIMMCELPSNAILAEEFLEFFDGFSIGSNDLTQLTLGLDRDSGIIAHLFDERNPAVKKLLANAIQACNKAGKYIGICGQGPSDHPDLAKWLMEQGIESVSLNPDSVLETWFFLAEGQASA

SEQ ID NO: 24999 - protein, 369 aa, Acinetobacter baumannii
MKSRAAVAFAPGKPLEIVEIDVAPPKAGEVLIKITHTGVCHTDAFTLSGDDPEGVFPAILGHEGAGVVIEVGEGVTSVQPGDHVIPLYTAECKECLFCKSGKTNLCVAVRATQGKGVMPDGTTRFSYKGEPIYHYMGCSTFSEYTVVAEVSLAKINPEANHEQVCLLGCGVTTGIGAVHNTAKVQEGDSVAVFGLGGIGLAVVQGARQAKAGRIIVVDTNPDKFELAKQFGATDFLNPKDYDQPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLQDINTAFDLMHEGKSIRTVIHF

SEQ ID NO: 25000 - protein, 373 aa, Burkholderia cepacia
MDDVQFQLQQADAREQPSGAYDATTRVAASWYVAMRSDDLKDKPLELTLFGRPCVAWRGAMGRAVVMDRHCSHLGANLADGQVKDGCIQCPFHHWRYDEQGQCVHIPGHSEAVHRLEPVPRGARQPTLVTTERYGYVWVWYGSPQPLHPLPDIAAADVDNGDFMHLHFAFETTTAVLRIVENFYDAQHAHPVHALPISAFELKLCDDWRPWPEVEPLARAGAWFGAGIDFTVNRYFGPLGMLSRALGLSMSQMNLHFDGYPGGCVMTVALDGDAKYKLLQCVTPVSDGRNVMHMLISIRKAGGPVRRAIDYVLFGLQTRQAAGYDVKIWNGMKPDGGGAYSKYDKLVLKYRAFYRGWVDRVASSERQGVSRRS

SEQ ID NO: 25001 - protein, 379 aa, Myxococcus fulvus
MSGNIHQEPERIRQASGVNDLTTQTAASWYVAMRSDALRGKPVAIKLFGQPLVAWRDGGGRPVVMERYCSHLGASLAKGKVVEGCIQCPFHNWRYDSTGACSHVPGHSTEVPRLEPIPPTARQSVYPVMERYGFVWVWYGTKAPLFPLPEMPEAESSESHQSLRFAYETTTSVLRIIENFYDAQHAAPVHQLPISAFELKLFDESSPPPGQEALARDGAWFGAGIDFHVDRYFGPLGVISRTLGLSMSRMQLHFDGYPGGCIMTVSLDGDVKYRLLQCVTPVDKEETVMHMLLAIKKGDGVVRSAANFILYGLQTWAAAGYDVAIWNSMKADGGGAFSKYDQLILKYRAFYRRWVNKVALENSGREKDSRADPRKGAHG

SEQ ID NO: 25002 - protein, 370 aa, Burkholderia pyrrocinia
MNDVQLDQARTEEHPPGVYDATTRLAASWYVAMRSDDLKDKPTELMLFGRPCVAWRGATGRAVVMDRHCSHLGANLADGRVEDGCIQCPFHHWRYDEQGQCVHIPGHSSAVSRLEPVPRGARQPTLVTAERYGYVWVWYGSPQPLHPLPEIAAADVDNGDFMHLHFAFETTTAVLRIVENFYDAQHANPVHALPISAFELKLFDDWRQWPEVESLARAGAWFGAGIDFTVDRYFGPLGMLSRALGLSMSQMNLHFDGYPGGCVMTVALDGDFKYKLLQCVTPVSDGKNVMHMLISIKKVGGALRRATDYVLFGLQTRQAAGYDVKIWNGMKPDGGGAYSKYDKLVLKYRAFYRDWVDRVAEATARPRRRE

SEQ ID NO: 25003 - protein, 318 aa, Tetrahymena thermophila
MNNNTFGSDRYEKLLKVGEGTYGEVYKAKDIQSSEIVALKKIKLENEDEGVPSTALREISILKELQPHPNIVCMHEVIYQPQEKKLYLVFEFVDQDLKKFLDQYRKDKKLQLRPYQIKLMMYQILNGLNFCHSRRIIHRDLKPQNILIDAKGNIKIADFGLARAFGVPIKTLTHEVETLWYRAPEILLGQKAYSLGVDIWSLGCIFHEMVEKRALFMGDSEIDQIFKIFQYHGTPTEQTWPALKECPYFKPIYPRFKTADPKTYFKNFCDKGFDLIQQMIALDPAKRISVKDALRHPYFEDLSREDIAKFEPNQVHMY

SEQ ID NO: 25004 - protein, 432 aa, Cryptococcus neoformans var. neoformans
MGGCMSTPEAPKKTAETKQVPSSSTSSRPPQASTSATATAAGAGTSAANGTANGIKGDTTATNRVGTSGGQGLAAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDAGLDAVIPSEILYNIESLWHDPVIPSVMDRSSEFYLMDSATYFFANIRKIAGPDYVPDEADVLRARTKTTGISETRFNMGQLSIHMFDVGGQRSERKKWIHCFEAVTSIIFCVALSEYDQVLLEESGQNRMQESLVLFESVINSRWFLRTSVILFLNKIDLFKQKLPKVPLVQYFPEYTGGADINKAAKYILWRFTQTNRARLSVYPHLTQATDTSNIRLVFAAVKETILQNALRDSGIL

SEQ ID NO: 25005 - protein, 505 aa, Drosophila melanogaster
MALVCALTNEVPETPVVSPHSGAVFEKRVIEKYLLENGCDPISGKELKPEELIEIKTPAVVKPKPPSATSIPATLKTMQDEWDALMIHSFTQRQQLQTTRQELSHALYQHDAACRVIARLNKEVAAAREALATLKPQAGIANAPTAIPQPALASEAGGAAAHPMEQAGMSAEVIQKLQDKATVLTQERKKRGRTVPEDLVTTDQVKNFLTVASHPGLHSASVPGILALDINSADHSKILTGGNDKNATVFNKDTEQMVAILKGHTKKITKVIYHPNEDTVITGSPDMNIRIWHVPTSQTQLLLRCHEGPVTGLSLHPTGDYLLSTSSDKHWAFSDIRTGRLLTKVIDTAEVGLTTAQFHPDGLIFGTGTVDSQVKIWDLKEQSNVANFPGHTGPISAISFSENGYYLATAADDACVKLWDLRKLKNFKTIQLDDGYEVKDLCFDQSGTYLAIAGSDVRVYLCKQWQELKVFNDHTALATGVRFGKHAQYLASTSMDRTLKLYAIE

SEQ ID NO: 25006 - protein, 657 aa, Oryza sativa (indica cultivar-group)
MDFTNLLITVLLLLSPLKYESDVATASDDEDFFKTCSSQRCSKHGPEIRYPFRLSTQPPSCGAPGMQLSCSGQDTILDHPVLGSCKVTMIYYRHVIMNAIPLVDSLPHCPLQKLVSVNQSTAVYKPHTSEVASVVGCSRDSIDTNQYGIVGPTSCPSLANNASQFWYLAYPYDNMSILPLGCTIVSKDIPMPYSYDKNGPNFDISIFTETAKRVISTGETVFTWYQVTVTSICQQCEREGRRCGFSSQRESSILPASYVNRVETRTYPSYTTLVRKLCTCIFPAMLCKIIESGPRVTIIAATSSVGTFIVLSLIVATALYISLKSRYNEEIHLKVEMFLKTYGTSKPTRYTFSEVKKIARRFKDKLGHGAFGTVYKGELPNGVPVAVKMLENSVGEGQEFINEVATIGRIHHANIVRLLGFCSEGTRRALIYELMPNESLEKYIFPHGSNISRELLVPDKMLDIALGIARGMEYLHQGCNQRILHFDIKPHNILLDYSFNPKISDFGLAKLCARDQSIVTLTAARGTMGYIAPELYSRNFGAISYKSDVYSFGMLVLEMVSGRRNTDPPAENQNEFYFPEWVFERVMNGQDLVLTMETTQGEKEMVRQLAIVALWCIQWNPKDRPSMTKVVNMLTGRLQNLQVPPKPFISSQNQLVI

SEQ ID NO: 25007 - protein, 844 aa, Oryza sativa (indica cultivar-group)
MRLLALAVASIVLANLHLLGVHGRDLLLSCGSNATVDADGRRWIGDMAPGLNFTLSSPGIAASQAGSSNANEIFGLVYHSARFFSTASWYNFSVLPGNYCLSLHFFPYTFGNFSGNDSLFDVTANDFKLVSKFNVSEEIVWRSTVSNSAINAVVKEYFLLVGSRGLQVEFDPSPGSFAFVNAIEVMLTPDNLFNDTVNKVGSAGNGQLPLGLSNRGLETMYRLNVGGHALNSSSDQYLHRPWYTDEAFMFSANAAQIVSNTSSVSYLSNNDSSISPIDVYETARIMSNNMVVDKRFNVSWRFYVHPNFDYLVRLHFCELFYDKPNQRVFKIYINNKTAAEDYDVYVRAGGINKAYHEDYFDNLPQQVDSLWLQLGPDSLTSASGTDPLLNGLEIFKLSRNGNLAYVLGHIDMGNQRGISKDRNRKILWEEVGIGSASFVTLTSVVLFAWCYIRRKRKADEKEPPPGWHPLVLHEAMKSTTDARAAGKSPLTRNSSSIGHRMGRRFSISEIRAATKNFDEALLIGTGGFGKVYKGEVDEGTTVAIKRANPLCGQGLKEFETEIEMLSKLRHRHLVAMIGYCEEQKEMILVYEYMAKGTLRSHLYGSDLPPLTWKQRVDACIGAARGLHYLHTGADRGIIHRDVKTTNILLDENFVAKIADFGLSKTGPTLDQTHVSTAVKGSFGYLDPEYFRRQQLTQKSDVYSFGVVLFEVACGRPVIDPTLPKDQINLAEWAMRWQRQRSLDAIVDPRLDGDFSSESLKKFGEIAEKCLADDGRSRPSMGEVLWHLEYVLQLHEAYKRNNVDCESFGSSELGFADMSFSLPHIREGEEEHHSKPSSIREDPDT

SEQ ID NO: 25008 - protein, 331 aa, Oryza sativa (indica cultivar-group)
MEANLPPGFRFHPRDEELIVDYLYHKLSGGDGGGGAGEFYGGVAMVDVDLNKCEPWELPAYFLHNLIIFPARARARAAGRRRRADAARVGATEWYFFSLHDRKYATGQRTNRATRSGYWKATGKDRAIVTRRRAAGGEAVAGGEVVGMRKTLVFYQGRAPRGSKTEWVMHEFRVDGHAVADHPSSSTSSSSSNLLKEDWVLCRVFYKSRTANPRPVVSGEAAVSLSGELSLPPPPPLPVAPAVIDGYTGGGYYEQDSSAGCHHHHHRPPTSAALPFKDLTDFRDLLSNMVQGGGAAAAAAKSEGFHLGWSEEESSGYVQQSAMASQAWNPF

SEQ ID NO: 25009 - protein, 263 aa, Streptomyces coelicolor
MSTTGTTPATTGYAAEFAGRTALVTGAASGIGLATARRLGAGGARVVVADFNAEGAEKAAAELRAGGVEAAAVELDVTRPESVEAAVGFAVDTFGSLDLAVNNAGIGGPSAPTGEYDVAAYQRVVRTNLDGVFYSMRYELPAIEAAGKGGSIVNVASILGSVGFAGSPAYVAAKHGVVGLTKAAAAEYAARGIRINAVGPGFIDTPLLKTMDEAAYKGWSPCTRPAASGAPRRSRTLIAFLLSDRASFVAGSYHLVDGAYTAV

SEQ ID NO: 25010 - protein, 428 aa, Lemna paucicostata
MSFRSILSDVRDSIGSFSRRRGAEVRISGVSDNHRGRNRVTAGDFPGEIGGEIPAIYQSRWAGLPPELLRDVIKRLEESESSWPARKHVVACAAVCTAWREMCKEIVSGPEFCGKLTFPVSLKQPGPREGTIQCFIKRDKSKSRYHLFLGLSPTLPAENGKFLLSQSASRALPARNTSSPWNADDISRSSSTYIGKLRSNFLGTKFIMFDTQPPTRHCRPAPSSGRVSRRFYSKVSPKVPSGNYAIAQVTYELNVLGKRGPRRMHCTMNSIPSSALDAGGRVPAAPERILSRSLEDSFRSVSLSKDLGSSRFSEFGGEMEREEEEEGDRKKSGPLVLKNKAPRWHEQLQCWCLNFRGRVTVASVKNFQLIADGQATAAQAGASEHDKIILQFGKVGKDTFTMDNRYPLSAFQAFAICLSSFDTKLACE

SEQ ID NO: 25011 - protein, 326 aa, Oryctolagus cuniculus
MDLSATNHRIPLGDGNSIPIIGLGTYSEPKTTPKGSCATSVKIAIDTGYRHIDGAYIYQNEHEVGETFREKIAEGKVRREDIFYCGKLWATNHDPVMVRPTLERTLKVLKLDYIDLYIIEIPMAFKPGDVVYPRDENGKWLYHKTNLCATWEALEACKDAGLVKSLGVSNFNRQQLELLLNKPGLKHKPVCNQVECHPYFTQPKLLKFCQQHDIIIVAYSPLGTCRNPMWVNTSLPPLLKDTLLNSLGKKYKKTAAQIVLRFNVQRGVVVIPKSFNPERIKENFQIFDFSLTEEEMKDIEALNKNVRYVELLMWRDHPEYPFNDEY

SEQ ID NO: 25012 - protein, 305 aa, Entamoeba histolytica
MDNYIYSIAHQLYEMYLQDEDAFHSKRDYPHKKVFTELQKLRKIFFPDFFMKHQKITESHIASELTKLVDYIKDSVTAYNDELFAHQCVMAILEKLPSIKRTLKTDLIAAYAGDPAAPGLSLIIRCYPGFQAVIVYRIAHVLYECGERYYCREMMESVHSYTSIDIHPGASIKGHFFIDHGVGVVIGETAIIGEWCRIYQSVTLGAMHFQEEGGVIKRGTKRHPTVGDYVTIGTGAKVLGNIIVGSHVRIGANCWIDRDVDSNQTVYISEHPTHFVKPCTTKGMKNDTEIIAIIPSSPLANSPSI

SEQ ID NO: 25013 - protein, 305 aa, Entamoeba dispar
MDTYIYSIAHKLYEMYLQDEEAFHSKRDYPHKEVFAELQRLRKIFFPDFFMKHQNISESHLACELTKLVDHIKNSVAAYNDELFAHQCIMAMLEKLPSIKKTLKTDLIAAYAGDPAAPGLSLIIRCYPGFQAVVVYRIAHILYECGERYYCRELMENVHSYTSIDIHPGASIKGHFFIDHGVGVVIGETAILGEWCRIYQSVTLGAMHFQEEGGVINRGTKRHPTVGDYVTIGTGAKVLGNIIVGSHVRIGANCWIDRNIDSNQTVYISEHPTHFVKPCANKGVKSDCEIIAMIPSSPSANSPSI

SEQ ID NO: 25014 - protein, 300 aa, Entamoeba dispar
YSIAHKLYEMYLQDEEAFHSKRDYPHKEVFAELQRLRKIFFPDFFMKHQNISESHLACELTKLVDLIKNSVAAYNDELFAHQCIMAILEKLPSIKKILKTDLIAAYAGDPAAPGLSLIIRCYPGFQAVIVYRIAHILYECGERYYCRELMENVHSYTSIDIHPGASIKGHFFIDHGVGVVIGETAILGEWCRIYQSVTLGAMHFQEEGGVINRGTKRHPTVGDYVTIGTGAKVLGNIIVGSHVRIGANCWIDRNIDSNQTVYISEHPTHFVKPCANKGVKSDCEIIAMIPSSPSANSPSI

SEQ ID NO: 25015 - protein, 1154 aa, Homo sapiens
PRAAARGGGGDAGTRGRGFVQAGRGAPMAECGRGGAAGGALPTSPGPALGAKGALKAGVGEGGGGGGRLGHGRARYDSGGVSNGDCSLGVSGDEARASPTRGPRGVALAPTPSAVVCTLPRESKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 25016 - protein, 244 aa, Tetrahymena pyriformis
MSLSREELIYMAKIAEQTERFEDMLEYMKKVVQTGQELSVEERNLLSVAYKNTVGSRRSAWRSISAIQQKEESKGSKHLDLLTNQKKKIETELNLYCDDILKLLNDFLIKNATNAEAQVFFLKMKGDYYRYIAEYAQGDEHKKAADGALDSYNKACEIANSELRPTHPIRLGLALNFSVFHYEVLNDPSKACTLAKTAFDEAIGDIERIQEDQYKDATTIMQLIRDNLTLWTSEFQDDAEEQQE

SEQ ID NO: 25017 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKTVANHFDGKLNILVNNAGIVIYKEAKDYTMEDYSLIMSINFEAAYHLSVLAHPFLKASQRGNVVFISSISGASALPYEAVYGATKGAMDQLTRCLAFEWAKDNIRVNGVAPGVIASSMVEMTIQDQEQKENLDKLIDRCALHRMGEPKELAAVVAFLCFPAASYVTGQIIYVDGGFMANGGF

SEQ ID NO: 25018 - protein, 161 aa, Emericella nidulans
MAEKMLVMTSNDGKNIEVPRDVAERSLLIKNMLEDLGDPTEPIPIPNVSENVLSKVLEWCAHHRNDPPSSADDDDSRRKTTDIEEWDQKFMQVDQEMLFEIILAANYLDIKPLLDIGCKTVANMIKGKSPEEIRKTFNIQNDFTPEEEDQIRRENEWAEDR

SEQ ID NO: 25019 - protein, 751 aa, Acetabularia mediterranea
MGQTITYAIPVFGVLALLYTFWRSSWVSKQEVGTERMGRIAKNITDGAMAFLKAEYRVLAIFVIAVAILLGISGNREGTSPLIAVSFILGAICSALAGYIGMIVATKANVRTTNAARSSLGRALEVAFAGGSVMGLGVVGLGVLGLGTLFLAYSNIGWDINRVITVITGFSFGASSIALFARVGGGIYTKAADVAADLVGKVEAGIPEDHPLNPATIADNVGDNVGDVAGMGADLFESYVGSIIGTMVLGATFIGVAGFQETNDFNGLNAVLLPLVLAGTGIITSIVGTFFVKVKEGGNPQKALNTGEFLASGIMLVLTYLIVDWMLPSTWTSATGVSYSSFGVFMAVIFGLVAGLLIGMITEFYTGTGTRPVKGIVSQSLTGSATNIIAGLGVGMQSTAIPIVILAAAIIGAHEFAGLYGIAIAAVGMLSNTGIQLAVDAYGPISDNAGGIAEMGELPKEVRGRTDKLDAVGNTTAAIGKGFAIGSAALTALALFAAFMETAKITEINVADPLVMAGLFLGGMLPFLFSSLAMNAVGRAAMDMIQEVRRQFKTIPELKAALDTMRKNDGKEFAEWSEADQTIFNAADGKAEYSKCVEISTKASIREMVLPGLIAVLTPVVIGFAGGAEMLGGLLAGVTVSGVLMAIFQSNSGGAWDNAKKMFEEGVEIDGQMHYKGSDAHKAAVVGDTVGDPFKDTSGPSPNILLKLMSVVALVIAPFLDQSTKNTLQVLEPHRHIGGAFLLDVRPHSKI

SEQ ID NO: 25020 - protein, 67 aa, Secale cereale
GNWCHEYRKLKAKVETIQKCQKHLMGEDLESLNLKELQQLEQQLESSLKHIRSRKNQLMAESISELQ

SEQ ID NO: 25021 - protein, 67 aa, Secale strictum subsp. kuprijanovii
GNWCHEYRKLKAKVETIQKCQKHLMGEDLESLNLKELQQLEQQLESSLKHIRSRKNQLMPESISELQ

SEQ ID NO: 25022 - protein, 752 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGKMKEKEARSKFRQGCQAGQTIKVQVSFDLLSLMFTFIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADGDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 25023 - protein, 131 aa, Homo sapiens
GTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALK

SEQ ID NO: 25024 - protein, 247 aa, Homo sapiens
MVDPEQLVQKARLAEQAEGYDDMAAAMKNVTELNEPLSNEERNLLSVAYKNVVGARRSSWRVISSIEQKTSADGNEKIEMVRAYREKVEKELEAVCQDVLSLVDNYLYKNCSETQYERKDLYLKMKGDYYRYLAEVATGEKRGDVVESSEKAYSEREISKEHMQPTHPIRLGLALNYSVFYYEIQNAPEQACHLAKTEFEDAIAELDTLNEESYKDSTLIMQLLRDNLTLWTSDQQDDHDGGEGNNN

SEQ ID NO: 25025 - protein, 160 aa, Glycine max
MASADVEYRCFVGGLAWATDDHALERAFSQYGEIVETKIINDRETGRSRGFGFVTFASEQSMKDAIGAMNGQNLDGRNITVNEAQSRGGGGGGGGGGGGYNRGGGGYGGRSGGGGGGGGYRSRDGGYGGGYGGGGGGGYGGGRDRGYSRGGDGGDGGWRN

SEQ ID NO: 25026 - protein, 354 aa, Homo sapiens
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTPELAGVIKRLWRDGGVQACFSRSREYQLNDSASYYLNDLDRISQSNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 25027 - protein, 492 aa, Homo sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTAFRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 25028 - protein, 535 aa, Oryza sativa (japonica cultivar-group); identical to SEQ ID NO: 799

SEQ ID NO: 25029 - protein, 511 aa, Liquidambar styraciflua
MDSSLHEALQPLPMTLFFIIPLLLLLGLVSRLRQRLPYPPGPKGLPVIGNMLMMDQLTHRGLAKLAKQYGGLFHLKMGFLHMVAVSTPDMARQVLQVQDNIFSNRPATIAISYLTYDRADMAFAHYGPFWRQMRKLCVMKLFSRKRAESWESVRDEVDSAVRVVASNIGSTVNIGELVFALTKNITYRAAFGTISHEDQDEFVAILQEFSQLFGAFNIADFIPWLKWVPQGINVRLNKARGALDGFIDKIIDDHIQKGSKNSEEVDTDMVDDLLAFYGEEAKVSESDDLQNSIKLTKDNIKAIMDVMFGGTETVASAIEWAMTELMKSPEDLKKVQQELAVVVGLDRRVEEKDFEKLTYLKCVLKEVLRLHPPIPLLLHETAEDAEVGGYYIPAKSRVMINACAIGRDKNSWADPDTFRPSRFLKDGVPDFKGNNFEFIPFGSGRRSCPGMQLGLYALETTVAHLLHCFTWELPDGMKPSELEMNDVFGLTAPRAIRLTAVPSPRLLCPLY

SEQ ID NO: 25030 - protein, 521 aa, Pycnoporus cinnabarinus
MISMGFRLFSLFVAIAAISGTLAAIGPKADLVISDAVVNPDGTPRAAVVVNGAFPGPLISGKKGDHFQLNVINKLTNHTMLKTTSIHWHGLFQEHTNWADGPAFVNQCPIASGHSFLYDFHVPDQAGTYWYHSHLSTQYCDGLRGPLVVYDPHDPQAHLYDVDNDDTVITLADWYHVAAKLGPQFPRGANSTLINGLGRAATDSTSDLTVIAVEHGKRYRFRLVSISCDPNHTFSIDGHNMTIIEVEGVNSKPLTVDSIQIFAAQRYSFVLNANQPVDNYWIRANPSGGTVGFEGGINSAILRYKGAPDAEPTNPTAPTSVIPLVETNLHPLKPMQVPGRSGIGNVDYAKTLNFNFNGTNFFINNATFTPPTVPVLLQILSGAHNAQDLLPAGSVYTLPPHSAIEITMPATTLAPGSPHPFHLHGHVFAVVRSAGSTEYNYHGPIFRDVVSTGLPGDSVTIRFMTDNPGPWFLHCHIDFHLEAGFAIVFAEDVNGIKYANPVPPSWAELCPIYDKLPESDH

SEQ ID NO: 25031 - protein, 391 aa, Carassius auratus gibelio
MASRGFAPLSGRQENLMVLGRADGLHALKPGQRVVLGVLTENDQHNRVFGQVSSKYVPAFRDASTLDVSTSSATLGVHVVEPVIAQATKPTSFLLPSELLLVDDVVQDLGSGSCMDSSMQSLPEEAAYEDILCVPEYAEDIHRYLRECEVKYRPKPGYMRKQPDITNCMRVILVDWLVEVGEEYKLCSETLFLAVNYLDRFLSCMSVLRGKLQLVGTAAVLLAAKYEEVYPPEVDEFVYITDDTYTKKQLLRMEQHLLRVLAFDMTAPTVHQFLMQYTLEGHICARTVNLALYLSELSLLEVDPFVQYLPSKTAAAAYCLANYTLNGVLWPENLYAFTGYSLAVIIPCLMELHKLHLGAAGRPQQAIQEKYKGSKYCGVSLLEPVECLPLP

SEQ ID NO: 25032 - protein, 391 aa, Carassius auratus
MASRGFAPLSGREENIMVLGRADGLHALKPGQRVVLGVLTENDQHNRVFGQVSSKYVPALRDASTLDVSTSSATLGVHVVEPVIAQATKPTSFLLPSELLLVDDVVQDLGSGSCMDSSMQSLPEEAAYEDILCVPEYAEDIHRYLRECEVKYRPKPGYMRKQPDITNCMRVILVDWLVEVGEEYKLCSETLFLAVNYLDRFLSCMSVLRGKLQLVGTAAVLLAAKYEEVYPPEVDEFVYITDDTYTKKQLLRMEQHLLRVLAFDMTAPTVHQFLMQYTLEGHICARTVNLALYLSELSLLEVDPFVQYLPSKTAAAAYCLANYTLNGVLWPENLYAFTGYSLAVIIPCLMELHKLHLGAAGRPQQAIQEKYKGSKYCGVSLLEPVESLPFP

SEQ ID NO: 25033 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTVCTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMSDVSAAASFRTGALNLNTWFLFKQYACCFGVELTMNNTAALYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 25034 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMADVSAAASFRTGALNLNTWFLFIQYACCFGVELTMNNAAALYFKEKFSLTTEEAAAIASIFGWMNLFARGAGGFLSDKANARMGMRGRLWTHTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 25035 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYHEMKKNGAMADVSAAASFRTGALNLNTWFLFIQYACCFGVELTMNNAAVLYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPEPDTQKTQDVNA

SEQ ID NO: 25036 - protein, 135 aa, Trypanosoma rangeli
MATPKQVSKKASRKRSGGRSAKAGLIFPVGRVGSLLRRGQYARRVGASGAVYMAAVLEYLTAELLELSVKAASQQAKRPKRLTPRTVTLAVRHDDDLGTLLRNVTLSRGGVMPSLNKALAKKHKSSKKARATPSA

SEQ ID NO: 25037 - protein, 377 aa, Pisum sativum
MSVAELKERHIAATETVNNLRERLKQRRLSLLDTDIAGYARSQGRAPVTFGPTDILCCRTLQGHTGKVYSLDWTSEKNRIVSASQDGRLIVWNALTSQKTHAIKLPCAWVMTCAFSPTGQSVACGGLDSVCSIFNLNSPTDRDGNLNVSRMLSGHKGYVSSCQYVPGEDTHLITGSGDQTCVLWDITTGLRTSVFGGEFQSGHTADVLSISINGSNSKLFVSGSCDATARLWDTRVASRAVRTFHGHEGDVNSVKFFPDGNRFGTGSEDGTCRLFDIRTGHQLQVYNQQHQDNEMAHVTSIAFSISGRLLIAGYTNGDCYVWDTLLAKVVLNLGSLQNSHEGRITCLGMSADGSALCTGSWDTNLKIWAFGGHRKVI

SEQ ID NO: 25038 - protein, 93 aa, Filobasidiella neoformans
WHGLRQLGTAFMDGVPGITQCPIPPGGSFTYNFTVSHQSGTYWWHSHYSNSMADGIWGPLIVHSPNEPLQRGRDYDEDRIVFITDWMHDNSEI

SEQ ID NO: 25039 - protein, 93 aa, Filobasidiella neoformans
WHGLRQLGTAFMDGVPGITQCPIPPGGSFTYNFTVSHQSGTFWWHSHYSNSMADGIWGPLIVHSPNEPLQRGRDYDEDRIVFITDWMHDNSEI

SEQ ID NO: 25040 - protein, 94 aa, Filobasidiella neoformans
WHGLRQLGTAFMDGVPGITQCPIPPGSSFTYQFTVSHQSGTFWWHSHYSNSMADGIWGPLIIHSANEPLQRGRDYDEDRIVFITDWVHDNSEVV

SEQ ID NO: 25041 - protein, 94 aa, Filobasidiella neoformans
WHGLRQLGTAFMDGVPGITQCPIPPGSSFTYQFTVSHQSGTFWWHSHYSNSMADGIWGPLIIHSPNEPLQRGRDYDEDRIVFITDWVHDNSEVV

SEQ ID NO: 25042 - protein, 94 aa, Filobasidiella neoformans
WHGLRQLGTAFMDGVPGITQCPIPPGSSFTYQFTVCHQSGTFWWHSHYTNSMSDSIWGPLIVHSPNEPLQRGRDYDEDRIVFITDWVHDNSEVV

SEQ ID NO: 25043 - protein, 91 aa, Cryptococcus neoformans var. grubii
WHGLRQLGTAFMDGVPGITQCPIPPGSSFTYQFTVSHQSGTFWWHSHYSNSMADGIWGPLIIHSPNEPLQRGRDYDEDRIVFITDWVHDNS

SEQ ID NO: 25044 - protein, 93 aa, Filobasidiella neoformans
WHGMRQKNSPYMDGIPGITQCPIPPGGSYTYNFTISDQSGTYWWHSHYSNAMADGLWGPLIVHSVHEPIQRGRDYDEDRIVFVSDWMHDNSEI

SEQ ID NO: 25045 - protein, 93 aa, Filobasidiella neoformans
WHGMRQKNTPYMDGIPGITQCPIPPGGSYTYNFTISDQSGTYWWHSHYSNAMADGLWGPLIVHSVDEPIQRGRDYDEDRIVFVSDWMHDNSEI

SEQ ID NO: 25046 - protein, 89 aa, Filobasidiella neoformans
WHGMRQKNTPYMDGVPGITQCPIPPGGSYTYNFTISDQSGTYWWHSHYSNAMADGLWGPLIVHSVDEPIQRGRDYDEDRIVVVTDWMHD

SEQ ID NO: 25047 - protein, 91 aa, Filobasidiella neoformans
WHGMRQKNTPYMDGVPGITQCPIPPRGSYTYNFTISDQSGTYWWHSHYSNAMADGLWGPLIVHSVDEPIQRGRDYDEDRIVVVSDWMHDDS

SEQ ID NO: 25048 - protein, 87 aa, Filobasidiella neoformans
WHGMRQKNTPYMDGVPGITQCPIPPGGSYTYNFTISDQSGTYWWHSHYSNAMADGLWGPLIVHSVHEPIQRGRDYDEDRIVFVTDWM

SEQ ID NO: 25049 - protein, 88 aa, Filobasidiella neoformans
WHGMRQKNTPYMDGVPGITQCPIPPGGSYTYNFTISDQSGTYWWHSHYSNAMADGLWGPHIVQSVDEPIQRGRDYDEVVIIVVTDWMN

SEQ ID NO: 25050 - protein, 92 aa, Filobasidiella neoformans
WHGMRQKNTPYMDGVPGITQCPIPPGGSYTYNFTISDQSGTYWWHSHYSNAMADGLWGPLIVHSVDEPIQRGRDYDEDRIVFVTDWMHDDSE

SEQ ID NO: 25051 - protein, 156 aa, Rumex acetosa
GGVCGYGNLYSQGYGTNTAALSTALFNDGLSCGACFEMRCSGDPRWCIGGVITVTATNFCPPNFALSNDNGGWCNPPLQHFDLAEPAFLQIAQYHAGIVPVSFRRVPCGRKGGIRFTINGHSYFNLVLITNVGGAGDVHSVSIKGSRGGWQAMSRN

SEQ ID NO: 25052 - protein, 156 aa, Rumex acetosa
GACGYGNLYSEGYGTSTAALSTALFNNGMSCGACFEIRCVNDGKWCLPGKSIVVTATNFCPPNNALPNNAGGWCNPPLQHFDLAQPVFQQIAQYRAGIVPVSYRRVPCNKKGGIRFTINGHSYFNLVLITNVGGAGDVHSVQVKGSRSGWQSMSRN

SEQ ID NO: 25053 - protein, 93 aa, Filobasidiella neoformans
  unsure (1)..(93): unsure at all Xaa locations
WHGLRQLGTAFMDGVPGITXCPIPPGGSFTYNFTVSHQSGTFWWHSHYSNSMADGIWGPLIVHSANEPLQRGRDYDEDRIVFITDWMHDNSEI

SEQ ID NO: 25054 - protein, 100 aa, Leishmania tarentolae
MAKGKRSADAKGSQKRQKKVLRDNIRGITRGCVRRMARRGGVKRISSEIYEEVRRVLKAYVEDIVRCSTAYTEYARKKTVTASDVVNALRKRGQILYGYA

SEQ ID NO: 25055 - protein, 84 aa, Mus spretus
MIQLSLDGKRLYATTSLYSAWDKQFYPDLIREGSMMLQIDVDTVNGGLKLNPNFLVDFGKEPLGPALAHELRYPGGDCSSDIWI

SEQ ID NO: 25056 - protein, 84 aa, Mus spretus
MIQLSLDGKRLYATTSLYSDWDKQFYPDLIREGSVMLQVDVDTVNGGLKLNPNFLVDFGKEPLGPALAHELRYPGGDCSSDIWI

SEQ ID NO: 25057 - protein, 432 aa, Nicotiana tabacum
MAGQTIIVSGLNPAAILQSTIGGGASPTAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMFDGNARCPMGPKYGALPEEVEPLLRAAQAARLTVSGVSFHIGSGDADSNAYLGAIAAAKEVFETAAKLGMSKMTVLDVGGGFTSGHQFTTAAVAVRSALKQHFDDQPELTIIAEPGRFFAETAFTLATTIIGKRVRGELREYWINDGLYGSMNCVLYDHATVNATPLAVLSNRTNVTCGGSKTFPTTVFGPTCDALDTVLRDYQLPELQVNDWLVFPNMGAYTKAAGSNFNGFNTCAIVTHLAYTYPS

SEQ ID NO: 25058 - protein, 355 aa, Colletotrichum lagenarium
MSRANAPNPSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 25059 - protein, 429 aa, Lycopersicon esculentum
MENGTKGKLTVSSSLQIEQPLPPSKLWKIIVVASIAAGVQFGWALQLSLLTPYVQLLGIPHRFASFIWLCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKSGKMRTANAFFSFFKAVGNILGYAAGSYSRLFKVFPFSKTKACDMYRANLKSCFFIAIFLLLSLTTLALTLVRENELPEKEELEIDEKLSGAGKSKVPFFGEIFGALKDLPRPMWILLLVTCLNWIAWFPFFLYDTDWMAKEVFGGQVGDAKLYDLGVRAGALGLLLQSVVLGFMSLGVEFLGKKIGGAKRLWGILNFVLAICLAMTILVTKMAEKSRGHDAAGTLMGPTPGVKIGALLLFAALGIPLAVTFSIPFALAS

SEQ ID NO: 25060 - protein, 719 aa, Plasmodium falciparum
MGKGHDVKKERGKKDEDEHNEYHPYRRDNKSFYSKNYKMKNKHSYNSSDEYKKYVSHDTYNSYDTYNSYKSHEEHKNNKHISIKPVNKNKYVHSPSPKKTKKIYDELSDYNKHKKYSSSKMDKKKDSYYKEQSNKYKEKRKYDESSQDTYDKKRKRKRKKKKYDYEREEEKYNRYDERRDSSYYTSNYSEDSSKREGGKKEKEDLYISRKEFSGKKKSHKGEHNNNNHHTDQHIKNNYHTDQHIKNNYHTDQHNNNNHHTDQHNNNNHHTDQHNNNNHYTDQHNNNNHHTDQHNNTISDQINIFPEKNKRDNRINEEKYTIKEHLIYEDEQNISYESNKDSSSEENTILNEYSSDEEKNKIDCILNGCRNVKNYKKLNKISEGTYGAVYRAQNKRTKKIVALKKLKNFSSMHNEGFAMTSLREINILLQLQHDNILSIKEVVFGKHLNDIYLVMEYIEHELKMILDNKSPSFTISELKCLLKQLLSGINYLHRNWVMHRDLKPTNLLYSNKGILKICDFGMARKFGHVTNHNFTKNVVTLWYRAPELLLGEQCYTNKIDIWSAGCIFAEMILKKPLFVGENEIDQLFKILCLLGLPDKESYPEFYEYSFISKNKELFKKKKIKMNVNNIRSHFPNIANQFSGLYLSDNGLDLLQKMLHYNPQCRISAQEALNHPYFNEFPKPLDIKDMPIVPDSNKFIRSNKMANHFKLNSQNNIQFHS

SEQ ID NO: 25061 - protein, 266 aa, Gossypioides kirkii
LSVEEIEVAPPQKNEVRVKIHFTSLCHTDVYFWEAKGQNPLFPRILGHEAGGVVESVGEGVKDVQLGDHVLPIFTGECNECPHCLSEASNMCDLLRINTERGGMLHDGKTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHDKPVQEVIAEMTGGGVDCSIECTGSIQAMISAFECVHD

SEQ ID NO: 25062 - protein, 350 aa, Sus scrofa
GNAAAAKKGSEQESVKEFLAKAKEDFLKKWENPAQNTAHLDQFERIKTLGTGSFGRVMLVKHKETGNHFAMKILDKQKVVKLKQIEHTLNEKRILQAVNFPFLVKLEYSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKDGVNDIKNHKWFATTDWIAIYQRKVEAPFIPKFKGPGDTSNFDDYEEEEIRVSINEKCGKEFSEF

SEQ ID NO: 25063 - protein, 324 aa, Bos taurus [sequence omitted]

SEQ ID NO: 25064 - protein, 800 aa, Drosophila melanogaster
MSRRRAHDTEDEGYDHRRNKRRRVSENQEIEDRLESLILRVGEATTSSVESNLEGLVSVLEADLGTFRLKILRILSDCAVAMPEKCTVYTTLVGLLNAKNYKFGGEFVDHMVKTFKESLKMCRWDAARYSLRFLADLVNCHVISATSLLQLLDTMIDVSNEDTVPQVRRDWFVFAVLSTLPWVGRDLYEKKESALESLLLRIEVYLNKRSKKHHNALRVWSSDAPHPQEEYLDCLWAQIRKLRQDNWAEKHIPRPYLVFDSILCEALQHNLPTIVPPPHHDNFEYPMPWVVYRMFDYTDCPDGPNLPGAHSIERFLIEEHLHHIIETYHHERKDCAAQLLSFPYKHKIPLEYCIVEVVFAELFHMPTPRYLDICYGSILIELCKLQPATLPQVLAQATEILFMRIDSMNTSCFDRFVNWFSYHLSNFKFTWSWDEWDSCLLLDGEHPRPKFIQEVLQKCLRLSYHQRITEMMPTTYAKLIPLTPVPNYKYANEEAANLPGTTVAHQLVVAIRQKCTPEEVVNILKDIPNSGYSGEEMSDGSFNALKIDVFVQTLLNLGSKSFSHSFAAISKFHSVFRALAETEEAQICILHNIFELWSSHQQMMVVLIDKLLKLQIVDCSAVATWIFSKEMTGEFTKLYLWEILHLTIKKMNKHVIKLNTELSEAKEKLAKADSSSSDSEDDSSHKRKKPITHADKPSEEVVERMEEKLEAANVNQKRLFLIVFQRFIMILSEHLLRSDTDGRDPDTDWYRWTIGRLQQVFLMHHEQVQKYSSTLETLLFTSDLDTHILEVFQQFVALRA

SEQ ID NO: 25065 - protein, 444 aa, Toxoplasma gondii
MVVIKDIVAREILDSRGNPTIEVDVSTEGGVFRAAVPSGASTGIYEALELRDKDPKRYLGKGVLNAVEIVRQEIKPALLGKDPCDQKGIDMLMVEQLDGTKNEWGYSKSKLGANAILGVSIACCRAGAASKGLPLYKYIATLAGKTIDKMVMPVPFFNVINGGEHAGNGLALQEFLIAPVGAPNIREAIRYGSETYHHLKNVIKNKYGLDATNVGDEGGFAPNVATAEEALNLLVEAIKAAGYEGKIKIAFDAAASEFYKQDEKKYDLDYKCKTKNASKHLTGEKLKEVYEGWLKKYPIISVEDPFDQDDFASFSAFTKDVGEKTQVIGDDILVTNILRIEKALKDKACNCLLLKVNQIGSVTEAIEACLLAQKSGWGVQVSHRSGETEDSFIADLVVGLRCGQIKSGSPCRSERLCKYNQLMRIEESLGADCVYAGESFRHPK

SEQ ID NO: 25066 - protein, 128 aa, Argyroxiphium caliginis
QRNHRHYMGEEIESLSLKEIQNLEQQLDTGLKHIRTRKNQLLHESISELQKKGKAIQEQNTTLTKRIKEKEKDKTIPQSSHWEQYVDHDTIFLMPPPHPPLIIGGDYNQVGGGGGDGRSNELDLSLQP

SEQ ID NO: 25067 - protein, 128 aa, Argyroxiphium sandwicense
QRNHRHYMGEEIESLSLKEIQNLEQQLDTGLKHIRTKKNQLLHESISELQKKGKAIQEQNTTLTKRIKEKEKDKTIPQSSHWEQYVDHDTTFLMPPPHPPLNIGGDYNQVGGGRGDGRSNELDLSLQP

SEQ ID NO: 25068 - protein, 128 aa, Dubautia latifolia
QRNHRHYMGEEIESLSLKEIQNLEQQLDTGLKHIRTRKNQLLHESISKLQKKGKAIQEQNTTLTKRIKEKEKDKTIPQSSHWEQYVDHDTTFLMPPPHPPLIIGRDYNQVGGGGGDGRSNELDLSLQP

SEQ ID NO: 25069 - protein, 128 aa, Dubautia laxa
QRNHRHYMGEEIESLSLKEIQNLEQQLDTGLKHIRTRKNQLLHESISELQKKGKAIQEQNTTLTKRIKEKDKDKTIPQSSHCEQYVDHDTTFLMPPPHPPLNIGGDYNQVGGGRGDGRSNELDLSLQP

SEQ ID NO: 25070 - protein, 128 aa, Dubautia plantaginea
QRNHRHYMGEEIESLSLKEIQNLEQQLDTGLKHIRTRKNQLLHESISELQKKGKVIQEQNTTLTKRIKEKEKDKTIPQSSHWEQYVDHDTTFLMPPPHPPLNIGGDYNQVGGGRGDGRSNELDLSLQP

SEQ ID NO: 25071 - protein, 128 aa, Dubautia raillardioides
QRNHRHYMGEEIESLSLKEIQNLEQQLDTGLKHIRTRKNQLLHESISELQKKGKAIQEHNATLTKRIKEKEEDKTIPQSSHWEQYVDHDTTFLMPPPHPPLIIGGDYNQVGGGGGDGRSNELDLSLQP

SEQ ID NO: 25072 - protein, 128 aa, Dubautia raillardioides
QRNHRHYMGEEIESLSLKEIQNLEQQLDTGLKHIRTRKNQLLHESISELQKKGKAIQEQNTTLTKRIKEKEKDKTIPQSSHWEHYVDHDTTFLMPPPHPPLNIGGDYNQVGGGRGDGRSNELDLSLQP

SEQ ID NO: 25073 - protein, 128 aa, Dubautia scabra
QRNHRHYMGEEIESLSLKETQNLEQQLDTGLKHIRTRKNQLLHESISELQKKGKAIQEQNTTLTKRIKEKEKDKTIPQSSHWEQYVDHDTTFLTPPPHPPLNIGGDYNQVGGGRGDGRSNELDLSLQP

SEQ ID NO: 25074 - protein, 135 aa, Kyhosia bolanderi
QRNHRHYMGEDIESLSLKEIQNLEQQLDTGLKNIRTRKNQLLHESISELQKKGKAIQEQNTTLTKKIKEKEKVKTTMPQNTQWEMHNYVDPDTTFLMPPPPPALNMGGDYNQGGAGSSEAGGDGRTNELDLSLQP

SEQ ID NO: 25075 - protein, 130 aa, Harmonia nutans
QRNHRHYMGEEIESLSLKEIQNLEQQLDTGLKHIRTRKNQLLHESISELQKKGKAIQEQNTTLTKRIKEKEKDKTIPQSSHWEQPSYVDHDTTFLMLPPHPALNIGGDYNQVGGGGADGRSNELDLSLQP

SEQ ID NO: 25076 - protein, 136 aa, Osmadenia tenella
QRNHRHYMGEEIESLSLKEIQNLEQQLDTGLKHIRTRKNQLLHESISGLQKKGKAIQEQNTSLTKRIKEKENDKRMPQNSQWEHHSYVDHDTTFLMPPPHPTLNINGGDYDQVGGGGCGGADHDGRSNELDLSLQP

SEQ ID NO: 25077 - protein, 128 aa, Carlquistia muirii
QRNHRHYMGEEIESLSLKEIQNLEQQLDTGLKHIRTRKNQLLHESISELQKKGKAIQEQNTTLTKRIKEKEKDNTIPQSSHWEQYVDHDTTFLMPPPHPPINIGGDYNQVGGGGADGRSNELDLSLQP

SEQ ID NO: 25078 - protein, 128 aa, Anisocarpus scabridus
QRNHRHYMGEEIESLSLKEIQNLEQQLDTGLKHIRTRKNQLLHESISELQKKGKAIQEQNTTLTKRIKEKEKDKTIPQSSHWEQYVDHDTTFLLPPPHPPLNIGGDYNQVGGGGGDGRSNELDLSLQP

SEQ ID NO: 25079 - protein, 128 aa, Wilkesia gymnoxiphium
QRNHRHYMGEEIESLSLKEIQNLEQQLDTGLKHIRTRKNQLLHESISELQKKGKAIQEQNTTLTKRIKEKEKDKTIPQSSHWEQYVDHDTTFLMQPPHPPLNIGGDYNQVGGGRGDGRSNELDLSLQP

SEQ ID NO: 25080 - protein, 125 aa, Argyroxiphium caliginis
TNRQVTYSKRRNGIFKKALELTVLCDAKVSLIMFSNTGKFHEYISPSTTTKKIYDMYQTTLRFDLWTSHYERMTETMKKLKESNNKLRREIRRRVLGEDLDGLDMNDLTILEQQTQDSLTVVRER

SEQ ID NO: 25081 - protein, 125 aa, Argyroxiphium sandwicense
TNRQVTYSKRRNGIFKKAHELTVLCDAKVSLIMFSNTGKFHEYISPSTTTKKIYDMYQTTLGFDLWTSHYERMTETMKKLKESNNKLRREIRQRVLGEDLDGLDMNDLTILEQQMQDSLTVVRER

SEQ ID NO: 25082 - protein, 125 aa, Dubautia laevigata
TNRQVTYSKRRNGIFKKAHELTVLCDAKVSLVMFSNTGKFHEYISPSTTTKKIYDMHQTTLGFDLWTSHYERMTETMKKLKESNNKLRREIRQRVLGEDLDGLDMNDLTILEQQMQDSLTVVRER

SEQ ID NO: 25083 - protein, 125 aa, Dubautia latifolia
TNRQVTYSKRRNGIFKKAHELTVLCDAKVSLIMFSNTGKFHEYISPSTTTKKIYDMYQTTLGFDLRTSHYERMTETMKKLKESNNKLRREIRQRVLGEDLDGLDMNDLTILEQQMQDSLTVVRER

SEQ ID NO: 25084 - protein, 125 aa, Dubautia laxa
TNRQVTYSKRRNGIFKKAHELTVICDAKVSLIMFSNNGKFHVYISPSTTTKKIYDMYQTTLGFDLWTSHYERMTETMKKLKESNNKLRREIRQRVLGEDLDGLDMNDLTILEQQMQDSLTVVRER

SEQ ID NO: 25085 - protein, 125 aa, Dubautia plantaginea
TNRQVTYSKRRNGIFKKAHELTVLCDAKVSLIMFSNTGKFHEYISPSTTTKKIYDMYQTTLGFDLWTSHYERMTETLKTLKESNNKLRREIRQRVLGEDLDGLDMNDLAILEQQMQDSLTVVRER

SEQ ID NO: 25086 - protein, 125 aa, Dubautia raillardioides
TNRQVTYSKRRNGIFKKAHELTVLCDAKVSLIMFSNTGKFREYISPSTTTKKIYDMYQTTLGFDLWISHYERMTETMKKLKESNNKLRREIRQRVLGEDLDGLDMNDLTILEQQMQDSLTVVRER

SEQ ID NO: 25087 - protein, 125 aa, Dubautia scabra
TNRQVTYSKRRNGIFKKAHELTVLCDAKVSLIMFSNTGKFHEYISPSTTTKKIYDMYQTTLGFDLWTSHYERMTETMKKLKESNNKLRREIRQKVLGEDLDGLDMNDLTILEQQMQDSLTVVRER

SEQ ID NO: 25088 - protein, 125 aa, Argyroxiphium caliginis
TNRQVTYSKRRNGIFKKAHELTVLCDAKVSLIMFSNTGKFHEYISPSTTTKKIYDMYQTTLGFDLWSSHYERMTETMKKLKDSNNKLRREIRQRVLGEDLDGLDMNDLTTLEQQMQDSLTVVRER

SEQ ID NO: 25089 - protein, 125 aa, Argyroxiphium sandwicense
TNRQVTYSKRRNGIFKKAHELTVLCDAKVSLIMFSNTGKFHEYISPSTTTKKIYDMYHTTLGFDLWSSHYERMTETMKKLKDSNNKLRREIRQRVLGEDLDGLDMNDLTILEQQMQDSLTVVRER

SEQ ID NO: 25090 - protein, 125 aa, Dubautia laevigata
TNRQVTYSKRRNGIFKKAHELTVLCDAKVSLIMFSNTGKFHEYISPSTTTKKIYDMYQTTLRFDLWSSHYERMTETMKKLKDSNNKLRREIRQRVLGEGLDGLDMNDLTILEQQMQDSLTVVRER

SEQ ID NO: 25091 - protein, 125 aa, Dubautia latifolia
TNRQVTYSKRRNGIFKEADELTVLCDAKVSLIMFSNTGKFHEYISPSTTTKKIYDMYQTTLGFDLWGSHYERMTETMKKLKDSNNKLRREIRQRVLGEDLDGLDMNDLTILEQQMQDSLTVVRER

SEQ ID NO: 25092 - protein, 125 aa, Dubautia laxa
TNRQVTYSKRRNGIFKKAHELTVPCDAKVSLIMFSNTGKFHEYISPSTTTKKIYDMYQTTLGFDLWSSHYERMTETMKKLKDSNNKLRREIRQRVLGGDLDGLDMNDLTILEQQMQDSLTVVRER

SEQ ID NO: 25093 - protein, 125 aa, Dubautia raillardioides
TNRQVTYSKRRNGIFKKAHELTVLCDAKVSLIMFSNTGKFHEYISLSTTTKKIYDMYQTTLGFDLWSSHYERMTETMKKLKDSNNKLRREIRQRVLGEDLDGLDMNDLTILEQQMQDSLTVVRER

SEQ ID NO: 25094 - protein, 125 aa, Dubautia scabra
TNRQVTYSKRRNGIFKKAHELTVLCDAKVSLIMFSNTGKFHEYISPSTTTKKIYDMYQTTHGFDLWSSHYERMTETMKKLKDSNNKLRREIRQRVLGEDLDGLDMNDLTILEQQMQDSLTVVRER

SEQ ID NO: 25095 - protein, 125 aa, Dubautia sherffiana
TNRQVTYSKRRNGIFKKAHELTVLCDAKVSLIMFSNTGKFHEYISPSTTTKKIYDMYQTTLGFDLWSSHYERMTETMKKLKDSNNKLRREIRQRVVGEDLDGLDMNDLTILEQQMQDSLTVVRER

SEQ ID NO: 25096 - protein, 125 aa, Wilkesia gymnoxiphium
TNRQVTYSKRRNGIFKKAHELTVLCDAKVSLIMFSNTGKFHEYISPSTTTKKIYDMYHTTLGFDLWSSHYERMTETMKKLKDSNNKLRREIRQRVLGEDLDDLDMNDLTILEQQMQDSLTVVRER

SEQ ID NO: 25097 - protein, 125 aa, Adenothamnus validus
TNRQVTYSKRRNGIFKKSHELTVLCDAKVSLIMFSNTGKFHEYISPSTTTKKIYDMYQTTLGFDLWSSHYERMTETMKKLKDSNNKLRREIRQRVLGEDLDGLDMNDLTILEQQMQDSLTVVRER

SEQ ID NO: 25098 - protein, 125 aa, Kyhosia bolanderi
TNRQVTYSKRRNGIFKKAHELTVLCDAKVSLIMFSNTGKFHEYVSPSTTTKKIYDMYQTTLGFDLWSSHYERMTETMKKVKESNNKLRREIRQRVLGEDLDGLDMNDLTILEQQMQDSLTVVRER

SEQ ID NO: 25099 - protein, 125 aa, Harmonia nutans
TNRQVTYSKRRNGIFKKAHELTVLCDAKVSLIMFSNTGKFHEYISPSTTTKKIYDMYQTTLGFDLWSSHYERMTETMKKLKDSNNKLRREIRQRVLGEDLDGLDMNDLTILEQQMQDSLTVVRER

SEQ ID NO: 25100 - protein, 125 aa, Osmadenia tenella
TNRQVTYSKRRNGIFKKAHELTVLCDAKVSLIMFSNTGKFHEYISPSTTTKKIYDMYQTTLGFDLWSSHYERMTETMKKLKDSNNKLRREIRQRVLGEDLDGLDINDLTILEQQMQDSLTVVRER

SEQ ID NO: 25101 - protein, 125 aa, Carlquistia muirii
TNRQVTYSKRRNGIFKKAHELTVLCDAKVSLIMFSNTGKFHEYISPSTTTKKIYDMYQTTLGFDLWSSHYERMTEIMKKLKDSNNKLRREIRQRVLGEDLDGLDMNDLTILEQQMQDSLTVVRER

SEQ ID NO: 25102 - protein, 125 aa, Anisocarpus scabridus
TNRQVTYSKRRNGIFKKAHELTVLCDAKVSLIMFSNTGKFHEYISPSTTTKKIYDMYQTTLGFDLWSSHYERMTETMKKLKESNNKLRREIRQRVLGEDLDGLDMNDLTILEQQMQDSLTVVRER

SEQ ID NO: 25103 - protein, 521 aa, Zea mays; identical to SEQ ID NO: 5802

SEQ ID NO: 25104 - protein, 341 aa, Legionella pneumophila
MQDDEEPIKDKEFKEEEWSEPDDESLLSEEDVEPDIEKMEEELDELPEFTDDETFPSFQRGKNIAKALDATQLYLGEIGFSPLLTAEEEIHYATLALKGDMEARKKMIESNLRLVVKIARRYLNRGLPLLDLIEEGNLGLMKSVEKFDPKRGFRFSTYATWWIRQTIERAIMNQTRTIRLPIHVVKELNVYLRAARQLTQKLDHEPSPEEIAEMVDKPLEDVQKLLGLNDKVASVDTPIGFDETKSLLDTIADENSLNPAELLTNENLRQHIESLLDKLTENQQQVIARRFGLRGFEKATLEDVGKEIDLTRERVRQIQVEALKTLRTLLERVGLTQEDLF

SEQ ID NO: 25105 - protein, 152 aa, Brassica napus
MESSPAAAAKPARGAGGRKGGDRKKSVSKSVKAGLQFPVGRISRYLKKGRYAIRYGAGAPVYLAAVLEYLAAEVLELAGNAARDNKKNRINPRHLCLAIRNDEELGKLLHGVTIASGGVLPNINPVLLPKRSASQTEKPEKAAKAAKSPKKA

SEQ ID NO: 25106 - protein, 248 aa, Malus x domestica
MGRGRVELKRIENKINRQVTFAKRRNGLLKKAYELSVLCDAEVALIIFSSRGKLYEFCSSFSMMKTLEKYQSCSYGSLEANLPANETQNSYQDYLMLKARVEVLQQSQRNLLGEDLSHLNTKELEHLEHQLETSLKQIRSRKTQFILDQLSDLQNREQMLVEANKALKRKLEETSVQAPEGMAWEAAGHGPNNIQQTRLPSHSEAFFHPLEGNNSSSQIGYTHMGSDNEMNVGNPGQYVNGYIPGWML

SEQ ID NO: 25107 - protein, 235 aa, Malus x domestica
MGRGKVELKRIENKINRQVTFAKRRNGLLKKAYELSVLCDAEVALIVFSTSGKLYEFCSGPSIAKTLERHQRCTYGELGASQSAEDEQSRYQEYLKLKTKVEALQRTQRHLLGEDLVHLGTKELQQLENQLDVSMKKIRSTKTQFMHVQISELQRKEEMLLEANTGLRRKLEEITAGHQRSWNGNHQAAQLEGFPEHLQYNNALQIGTPVVTNDEANVATSSAQNGTGFFPGWML

SEQ ID NO: 25108 - protein, 698 aa, Candida albicans
MTSLQQQQQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESINKSTTINDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSFTNIVNNTNSSSPLMNQQQQYYHQQQHQQQVTQSSLYQHHHQYHQ

SEQ ID NO: 25109 - protein, 138 aa, Tetrahymena thermophila
GGKGGKGGKVGGAKNKKTPQSRSYKAGLQFPVGRIHRFLKGRVSAKNRVGATAAVYAAAILEYLTAEVLELAGNASKDFKVRRITPRHLLLAIRGDEELDILIKATIAGGGVIPHIHKALLGKHSTKNRSSAKTAEPR

SEQ ID NO: 25110 - protein, 111 aa, Ipomoea batatas
YFLYQILRGLKYIHSANVIHRDLKPSNLLLNANCDLKICDFGLARPNIENEFMTEYVVTRWYRAPELLLNSSDYTGAIDVWSVGCIYMELMNRKPLFPGKDHVHQMRLLTE

SEQ ID NO: 25111 - protein, 301 aa, Homo sapiens
MEDEVVRFAKKMDKMVQKKNAAGALDLLKELKNIPMTLELLQSTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 25112 - protein, 255 aa, Homo sapiens
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 25113 - protein, 245 aa, Homo sapiens
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 25114 - protein, 380 aa, Oryza sativa (japonica cultivar-group); identical to SEQ ID NO: 3489

SEQ ID NO: 25115 - protein, 628 aa, Oryza sativa (japonica cultivar-group)
MFSLFVQRFNRRVAALPDVDDFFWEKDPTPILDTIDAPIHLKNLSSKELKQLAGEVRSEISFIMSRKCQPCNTGHSVVELAIAIHYVFNAPMDKILWDAGQHTYAHKILTGRRSLFHTIKQRKGLSGFTSRFESEYDPFGAGHGCNSLSAGLGMAVARDLGGRKNRIVTVISNWTTMAGQVYEAMGHAGFLDSNMVVILNDSRHTLLPKADSQSKMSINALSSALSKVQSSKGFRKFREAAKGLSKWFGKGMHEFAAKIDEYARGMIGPHGATLFEELGLYYIGPIDGNNIDDLICVLKEVSTLDSTGPVLVHVITENEKDSGGEFNSEITPDEEGPPDSSQDILKFLENGLSRTYNDCFVESLIAEAENDKHIVVVHGGMGIDRSIQLFQSRFPDRFFDLGIAEQHAVTFSAGLACGGLKPFCIIPSTFLQRAYDQIVEDVDMQKIPVRFAITSAGLVGSEGPTNSGPFDITFMSCLPNMIVMSPSNEDELIDMVATAAMVEDRPICFRYPKGAIVGTSGTLAYGNPLEIGKGEILAEGKEIAFLGYGDVVQRCLIARSLLFNFGIQATVANARFCKPLDIDLIRMLCQQHDFLITVEEGTVGGFGSHVSQFISLDGLLDGKIKVRI

SEQ ID NO: 25116 - protein, 298 aa, Escherichia coli O157:H7
MSQNTLKVHDLNEDAEFDENGVEVFDEKALVEEEPSDNDLAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 25117 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDKLDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 25118 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQSISDVDVWATQYERMQETKRKLLETNRNLRTQIKQRLGECLDELDIQELRRLEDEMENTFKLVRERKFKSLGNQIETTKKKNKSQQNIQKDLIHELELRAEDPHYGLVDNGGDYDSVLGYQIEGSRAYALRFHQNHHHYCPNHGLHAPSASDIITFHLLE

SEQ ID NO: 25119 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRERKFKSLGNQIETTMKKNKSQQGIQKNLIHELELRAEDPHYGLVDNGGDYDSVLGYQIEGSRAYALRFHQNHHHYYPNHGLHAPSASDIITFHLLE

SEQ ID NO: 25120 - protein, 232 aa, Arabidopsis thaliana
MARGKIQIKRIENQTNRQVTYSKRRNGLFKKAHELTVLCDARVSIIMFSSSNKLHEYISPDTTTKEIVDLYQTISDVDVWATQYERMQETKRKLLETNRNLRTQIKQRLGECLDELDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 25121 - protein, 232 aa, Arabidopsis thaliana
MARGKIQIKRIENQTNRQVTYSKRRNGLFKKAHELTVLCDARVSIITFSSSNKLHEYISPNTTTKEIVDLYQTISDVDVWATQYERMQETKRKLLETNRNLRTQIKQRLGECLDELDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 25122 - protein, 232 aa, Arabidopsis thaliana
MARGKIQIKRIENQTNRQVTYSKRRNGLFKRAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 25123 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRARKFESLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 25124 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRERKFKSLGSQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 25125 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRVGECLDELDIQELRRLEDEMENTFKLVRERKFKSLGNQIETTKKKSKSQQDIQKNLIHELELRAEDPHYGLVDNGGDYDSVLGYQIEGSRAYALRFHQNHHHYYPNHGLHAPSASDIITFHLLE

SEQ ID NO: 25126 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEKENTFKLVRERKFKSLGNQIETTKKKNKSQQDIQKNLIHELELRAEDPHYGLVDNGGDYDSVLGYQIEGSRAYALRFHQNHHHYYPNHGLHTPSASDIITFHLLE

SEQ ID NO: 25127 - protein, 208 aa, Arabidopsis thaliana
MGRGKIEIKRIENANNRVVTFSKRRNGLVKKAKEITVPCDAKVALIIFASNGKMIDYCCPSMDLGAMLDQYQMLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 25128 - protein, 208 aa, Arabidopsis thaliana
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQIEILISKRRNEKMMAEEQRQLTFQLQQQEMAIASNARGMMMRDHDGQFGYRVQPIQPNLQEKIMSLVID

SEQ ID NO: 25129 - protein, 208 aa, Arabidopsis thaliana
MGRGKIEIKRIENANNRVVTFSKRRNGLVKKAKEITVLCDAKVALIIFASNGKMIDYCCPSMDLGAMLDQYQKLSGKKLWDAKHENLSDEIDRIKKENDSLQLELRHLKGEDIQSLNLKNLMAVGHAIEHGLDKVRDHQMEILISKRRNEKMMAEEQRQLTFQLQQQEMAIASNARGMMMRDHDGQFGYRVQPIQPNLQEKIMSLVID

SEQ ID NO: 25130 - protein, 208 aa, Arabidopsis thaliana
MGRGKIEIKRIENANNRVVTFSKRRNGLVKKAKEITVLCDAKVALIIFASNGKMIDYCCPSMDLGAMLDQYQKLPGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 25131 - protein, 208 aa, Arabidopsis thaliana
MGRGKIEIKRIENANNRVVTFSKRRNGLVKKAKEITVLCDAKVALIIFASDGKMIDYCCPSMDLGAMLDQYQKLSGKKLWDAKHENLSNEIDRIKKENDSLQLELRHLKGEGIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 25132 - protein, 208 aa, Arabidopsis thaliana
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEVLISKRRNEKMMAEEQRQITFQLQQQEMAIASNARGMMMRDHDGQFGYRVQPIQPNLQEKIMSLVID

SEQ ID NO: 25133 - protein, 208 aa, Arabidopsis thaliana
MGRGKIEIKRIENANNRVVTFSKRRNGLAKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKITSLVID

SEQ ID NO: 25134 - protein, 292 aa, Nicotiana tabacum
MSQRTVPAPFLTKTYQLVDDATTDDVVSWNESGTTFVVWKTAEFAKDLVPTYFKHNNFSSFVRQLNTYGFRKIVPDKWEFANENFKRGQKELLTAIRRRKTVTPTPAGGKSVVPGTSASPDNSGEDLGSSSTSSPDSKNPGSVDTPGKSQFADLSDENEKLKKDNQMLSSELAQAKKQCDELVAFLNQYVKVAPDMINRIISQGTSGSSYGELVKEVIGGVNDLEAQGSDDDEKGDTLKLFGVLLKENKKKRGPDENADISGSRGKMMKTMDYNLPWMKMSSAPGESNKVCN

SEQ ID NO: 25135 - protein, 318 aa, Oryza sativa (japonica cultivar-group)
MNMDELLRSIWTAEESQAMASASAAAAAAEGGLHKQGSLTLPRTLSVKTVDEVWRDLQREASPGAAAADGGGGGGEHHQPRRQPTLGEMTLEEFLVRAGVVRENTAAAAAMVAAAAAPPVAPRSIPAVNNSSIFFGNYGGVNDAAAAAAGAMGFSPVGIGDPTMGNRLMSGVAGIGGGAITVAPVDTSVGQMDSAGKGDGDLSSPMAPVPYPFEGVIRGRRSGGNVEKVVERRQRRMIKNRESAARSRARKQAYTMELEAEVQKLKEQNMELQKKQEEIMEMQKNFFPEMQKNQVLEAVNNPYGQKKRCLRRTLTGPW

SEQ ID NO: 25136 - protein, 397 aa, Dictyostelium discoideum
MSLSQQSISIIKATVPVLQVHGVNITTTFYRNMFKANPQLLNIFNHSNQREGKQQNALANTVLQAAIHIDKLNELNLAPIVHKHVALGVLPEHYPIVGTNLLGAIKEVLQDAATDEILGAWGEAYGVIAQAFIDAEAALYKVTEEQIGGWRDTREFIVDRKVEESSNIISFYFKPADGKPIATYIPGQYITIKVPLTLENGEQRTHIRHYSLSDTPSEQYYRISVKKEDALKKSDPNGVVSNHLHANVKVGDKVLLSPPAGDYVVDQLSSNPILLVSGGVGITPLLSMAKATLAKQPEREVTFVHSSKNKQYQPFANELSQLEKSNKVKVSTVHSETDGQITKDKLEKFINPSQIKDTKVFICGPVSFMSAINKQLIELGYPKENISYEIFGPLTNV

SEQ ID NO: 25137 - protein, 423 aa, Dictyostelium discoideum
MLSQKSIQIIKSTVPLLEKYGVEITSLFYKNMFEAQPQFLNIFNHSNQRNQKQPVALANTILQSAIHIEKLNEINLMPIVHKHVALGITPEMYPIVGAHLLGAMKTVMQDEATPEIMAAWTEAYRAVAQAFMDAEEDLYFETEEQIGGWKDTREFVVDRIEEETPLIKSFYFKAYDGKEIATYIPGQYITVKITLPGDGVDVPTDKMRTYVRHYSLSDKPNDEYYRISIKKELGKNTPNGIVSNHFHNNIKVGDVVPMSVPAGDFVVNNDSETPILLICGGVGINPLFSMLKETLVQQPDRKINFIFSTHCESSQPFKEELKQLEDDYKETGNLKINLVYSENQGHINKEIIEKYSTQHVDQAEIDETDVYICGPVPFMMQVNKDLLQLGFHKENVHYELFGPLTPVLEENQMLRGVKNIIEN

SEQ ID NO: 25138 - protein, 230 aa, Homo sapiens
AGKKVLIVYAHQEPKSFNGSLKNVAVDELSRQGCTVTVSDLYAMNFEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 25139 - protein, 112 aa, Escherichia coli
MKLVTVIIKPFKLEDVREALSSIGIQGLTVTEVKGFGRQKGNAELYRGAEYSVNFLPKVKIDVAIADDQLDEVIDIVSKAAYTGKIGDGKIFVAELQRVIRIRTGEADEAAL

SEQ ID NO: 25140 - protein, 539 aa, Beta vulgaris
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAAGSYSRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGFKGGALAIFSVLGIPLAITFSIPFALASIFSASSGSGQGLSLGVLNLAIVVPQMFVSVTSGPWDALFGGGNLPAFVVGAVAATASAILSFTLLPSPHRKPKSEGQWVAIKNKEAVLIFNFLFFI

SEQ ID NO: 25141 - protein, 164 aa, Capsicum annuum
MADLMEKAKNYVVEKVGNMEKPEAEITDVDMKKVSMDSISYHANVAVKNPYSVPVPIMQISYALKCSGRIIVSGTIPDPGNIKANDTTMLDVPVKVPHSVLVSLAKDIGKDWDIDYTLELGLTIDLPVIGNFTIPLSHSGEIKLPSISDLWKGDNEEEETEKET

SEQ ID NO: 25142 - protein, 363 aa, Leishmania donovani
MAQLVPLVELPSGKKIYSVRGQQFEVDRQYDLVKVVGFGACGTVCSAVANGSGERVAIKRLSRVFGDLREGKRILREMEIMTSLKHNNLIRLHHFMRPQSKETFEDIYLVMDLYDTDLNRIIRSRQKLTDEHLQYFMIQAFRGLHYLHSAKVMHRDLKPSNLLVNADCALAICDFGLARDDQVMSSSDLTQYVVTRWYRPPEVLGMGSNQYTSAVDVWSLGLIFAELMLGRTLLPGTDYIGQLVMIVNLLGSPSIDDMEFLSSEAKAFILSQPRRPALSFRDLFPMATEEATDLLSKLLVFHPARRLTAKQVMEHPYFSKYRDAAEEADAPDPFVWNHSHIETKEQLREDLWRVVEAHSQSNG

SEQ ID NO: 25143 - protein, 224 aa, Hieracium piloselloides
MARGKIQIKKIENSTNRQVTYSKRRNGLFKKASELTVLCDAKVSIIMVSCTDKLHEYISPSTTTKQFFDQYQKAAGIDLWNSHYEKMQEELRQLKEVNKNLRRQIRQRLGDCLEHLGFEKLLDLEKESQEAVYIIRERKLKVIGNKLETSKKKVRSAQDVYKKLMHEFGIRGEDPQFGMIEDGEYDAVYGYPPQMSAPRILTFRLHPNNLHATASDLTTYALLG

SEQ ID NO: 25144 - protein, 228 aa, Hieracium piloselloides
MARGKIQIKKIENSTNRQVTYSKRRNGLFKKASELTVLCDAKVSIIMVSCTDKLHEYISPSTTTKQFFDQYQKAAGIDLWNSHYEKMQEELRQLKEVNKNLRRQIRQRLGDCLEHLGFEKLLDLEKESQEAVYIIRERKLKVIGNKLETSKKKVRSAQDVYKKLMHEFGIRGEDPQFGMIEDGEYDAVYGYPPQMSAPRILTFRLQPNNHPNNLHATASDLTTYALLG

SEQ ID NO: 25145 - protein, 517 aa, basidiomycete PM1
MAKFQSLLTFITLSLVASVYASIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGPAVPTADATLINGLGRSINTLNADLAVITVTKGKRYRFRLVSLSCDPNHTFSIDGHSLTVIEADSVNLKPQTVDSIQIFAAQRYSFVLNADQDVDNYWIRALPNSGTRNFDGGVNSAILRYDGAAPVEPTTTQTPSTQPLVESALTTLEGTAAPGNPTPGGVDLALNMAFGFAGGRFTINGASFTPPTVPVLLQILSGAQSAQDLLPSGSVYSLPANADIEISLPATSAAPGFPHPFHLHGHTFAVVRSAGSSTYNYANPVYRDVVSTGSPGDNVTIRFRTDNPGPWFLHCHIDFHLEAGFAVVMAEDIPDVAATNPVPQAWSDLCPTYDALSPDDQ

SEQ ID NO: 25146 - protein, 487 aa, Salmonella enterica subsp. enterica serovar Dublin
MKKINHWINGQNVAGDDYFQTTNPATGDVLAEVASGGEAKLNQAVAAAKEAFPKWANLPMKKRARLMRRLGDLIDQNVPEIAAMETADTGLPIHQTKNVLIPRASHKFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRGVSFTGGTATGRNIMKNAGLKKYSMELGGNSPVLIFEDAEIERALEAALFTIFLINGERCTAGLSIFIQQSIYPEFVKRFAERANRLRVGDPTDPNTQVGALISQQHWEKVSGYIRLGIEEGATLLAGGAEKPTDLPAHLKGGNFLRPTVLADVDNRMRVQEEIFGPVACLLPFKDEAEGLRLANDVEYGLASYIWTQDVSKVLRLARAIEAGMVFVNTQNVRDLRQPFGGVKASGTGREGGEYSFEVFAEMKNVCISMGDHPIPKWGV

SEQ ID NO: 25147 - protein, 115 aa, Lycopersicon esculentum
MEEEKHHHHHLFHHKDKAEEGPVDYEKEIKHHKHLEQIGKLGTVAAGAYALHEKHEAKKDPEHAHKHKIEEEIAAAAAVGAGGFAFHEHHEKKDAKKEEKKKLRGDTTISSKLLF

SEQ ID NO: 25148 - protein, 114 aa, Lycopersicon esculentum
MAEEKHQHHHHLFHHKNKEDEGGPVDYEKEVKHHSHLEKIGELGAVAAGALALHEKHKAKKDPEHAHKHKIEEEIMAVAAVGAGGFAFHEHHQKKDAKKEKKEVEGGHHHHHHY

SEQ ID NO: 25149 - protein, 78 aa, Lycopersicon esculentum
MAEEKQHHRLFHHKNREEEGGPVDHKKKVKHHSHLQKIGELGAVAAGRYALHEKHKAKKDPENAHKHKIKQEIAAVAA

SEQ ID NO: 25150 - protein, 415 aa, Brassica oleracea
MDPEGFTSGLFRWNPTRVMVQAPTPIPPPQQQSPATPQTAAFGMRLGGLEGLFGPYGVRFYTAAKIAELGFTASTLVGMKDEELEDMMNSLSHIFRWELLVGERYGIKAAVRAERRRLQEEEEEESSRRRHLLLSAAGDSGTHLALDALSQEDDWTGLSQEPVQHQDQTDAAGINGGGRGGYWEAGQTTIKKQQQRRRKKRLYVSETDDDGNEGEDDDGMDIVNGSGVGMERQREHPFIVTEPGEVARGKKNGLDYLFHLYEQCREFLLQVQTIAKDRGEKCPTKVTNQVFRYAKKSGANYINKPKMRHYVHCYALHCLDEEASNALRSAFKVRGENVGSWRQACYKPLVDIACRHGWDIDAVFNAHPRLSIWYVPTKLRQLCHLERNNAEAAAATLVGGISCRDRLRLDALGFN

SEQ ID NO: 25151 - protein, 421 aa, Mesocricetus auratus
MPGSSRQSGREAGSALLSLQQEDQENVNPEKAAPDQRARAALKTGNARGNAPQQRLKARRVAPLKDLSINDEHVASGPSWKAASKQPAFTIHVDEEEDTQKIPPEHKEMRCEDALAFNAAVSLPGARKPLVPLDYPMDGSFESPHAMDMSIVLEEEKPVSVNEVPDYHEDIHTYLREMEIKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYSKKQVLRMEHLVLKVLAFDLAAPTVNQFLNQYFLHQQPANCKVESLAMFLGELSLIDADPYLKYLPSLIAGAAFHLALYTVTGQSWPESLVQKTGYTLESLKPCLMDLHQTYLRAAQHTQQSIREKYKHSKYHGVSLLNPPETLNV

SEQ ID NO: 25152 - protein, 394 aa, Asterina pectinifera
  unsure (1)..(394): unsure at all Xaa locations
MQTACSGNLCGYQLMFSLSTVVTVCRSLRSRNRHWFLKLLGVRLTIAMRCALENISNVAKNNVQAAAKKEIKQKRGMTKSKATSSLQSVIGLHVEPVEKVQSPEPMDMSEVSNALEAFSQNILEMGVDDIDKDDHENPQLCSEYVNDIYLYMRHLEREFKVRTDYMAMQEITERMRTILIDWLVQVHLRFHLLQETLFLTIQILDRYLEGASVSKTKLQLVGVTSMLIAAYEEMYAEIGDFVYITDNAYSKAQIRAMECNILRKLDFNLGKPLCIHFLRRCSKAGGVDGHKHTLSKYIMELTLXEYSFVKYDXEIAAAALLSTRFWDEDMEWTKSLVHYSAYSEGHLGPIVQKMAVLSQQSHPSPNSRLDQEEDMASSKFMSDQQATQELKSIR

SEQ ID NO: 25153 - protein, 429 aa, Cricetulus longicaudatus
MALRVTRNTKLNTENKAKVSMTGAKRVPVAIAAASKPGLRPRTALGDIGNKVSEQAQARVPLKKELKTSVTGKVSAKIPPPKPQEKVPVSEPEVELAEPEPEPEPVMEEKLSPEPILVDNPSPSPMETSGCAPAEEYLCQAFSDVILAVSDVDADDGADPNLCSEYVKDIYAYLRQLEEEQSVRPRYLLGREVTGNMRAILIDWLIQVQMKFRLLQETMYMTVSIIDRFMQDNCVPKKMLQLVGVTAMFIASKYEEMYPPEIGDFAFVTNNTYTKHQIRQMEMKILRVLNFSLGRPLPLHFLRRASKIGEVDVEQHTLAKYLMELTMLDYDMVHFAPSQIAAGAFCLALKILDNGEWTPTLQHYLSYTEESLLPVMQHLAKNVVMVNRGLTKHMTIKNKYATSKHAKISTLAQLNCTLVQNLSKAVSKA

SEQ ID NO: 25154 - protein, 429 aa, Mesocricetus auratus
MALRVTRNTKLNTENKAKVSMAGAKAVPVTLAAASKPGLRPRTALGDIGNKVSEQAQARLPLKKELKTSVTGKVSAKIPPPKPLEKVPPVSEPEVELAETHEPEPVMDEKLSPEPILVDNPSPSPMETSGCAPAEEYLCQAFSDVILAVSDVDADDGADPNLCSEYVKDIYAYLRQLEEEQSVRPKYLLGREVTGNMRAILIDWLIQVQMKFRLLQETMYMTVSIIDRFMQDNCVPKKMLQLVGVTAMFIASKYEEMYPPEIGDFAFVTNNTYTKHQIRQMEMKILRVLNFSLGRPLPLHFLRRTSKIGEVDVEQHTLAKYLMELTLLDYDMVDFAPSQIAAGAFCLALKILDNGEWTPTLQHYLSYTEESLLPVMQHLAKNVVMVNHGLTKHMTIKNKYATSKHAKISTLAQLNCTLVQNLSKAVAKA

SEQ ID NO: 25155 - protein, 397 aa, Mesocricetus auratus
MALLRRPTVSSDLKNIDTGVNPKAKSHVTIRRAVLEEIGNKVRSRAAPVAKKPQNTKIPVQPTKVTHVNKQPKPTASVKPVQMETLAPKDPPAPEDVSMKEENLCQAFSDALLCKIEDIDNEDWENPQLCSDYVKDIYQYLRQLEVLQSINPHFLDGRDINGRMRAILVDWLVQVHSKFRLLQETLYMCIAIMDRFLQAQPVCRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSQVAAAASCLSQKVLGQGKWNLKQQYYTGYMETEVLEVMQHMAKNVVKVNENLTKFIAVKNKYASSRLLKISTIPQLNSKTIKDLASPLMGRL

SEQ ID NO: 25156 - protein, 513 aa, Solanum melongena
MVILPSELIGATIIYIIVYIIIQKLIATGSWRRRRLPPGPEGWPVIGALPLLGGMPHVALAKMAKKYGPIMYLKVGTCGMVVASTPNAAKAFLKTLDINFSNRPPNAGATHMAYNAQDMVFAPYGPRWKLLRKLSNLHMLGGKALENWANVRANELGHMLKSMFDASHVGERIVVADMLTFAMANMIGQVMLSKRVFVEKGKEVNEFKNMVVELMTVAGYFNIGDFIPQIAWMDLQGIEKGMKKLHKKFDDLLTKMFEEHEATSNERKGKPDFLDFIMANRDNSEGERLSITNIKALLLNLFTAGTDTSSSVIEWALTEMMKNPTIFKKAQQEMDQIIGKNRRFIESDIPNLPYLRAICKEAFRKHPSTPLNLPRVSSDACTIDGYYIPKNTRLSVNIWAIGRDPDVWENPLEFIPERFLSEKNAKIEHRGNDFELIPFGAGRRICAGTRMGIVMVEYILGTLIHSFDWKLPNDVVDINMEETFGLALQKAVPLEAIVTPRLSFDIYQSSEPF

SEQ ID NO: 25157 - protein, 301 aa, Leishmania mexicana
MTSRYERQEKIGEGTYGVVYKARDTSTAATVALKRIRLDSEEEGVPCTAIREISLLKELRHENIVKLLDVCHSEHRLTIVFEYLDLDLKKYLDRENGNLDAATIQHFMRDLLRGVAFCHQRSVLHRDLKPQNLLISREKELKLGDFGLGRSFAIPVRKFTNEVVTLWYRPPDVLLGSMQYGPPVDVWSVGCIFSEMATGTPLFAGKNDADQLMRIFRFLGTPNNRVWPSMNQYPNSNNMLSQPEFLQNFEPEWSNVLGSVPGYEKLGCAGVDLLERLLRYEPSERITAADALNHPYFSLQF

SEQ ID NO: 25158 - protein, 411 aa, Brassica napus
MAATAGATPSSHLLLSSSRHVAASPQPRILFPSLSGKRVAVGKNHHATGVRCMAVAADATAETKPAAKKKSGYELQTLTSWLLRQEMKGEIDTELTIVMSSIAMACKQIASLVQRAGISNLTGVQGAVNIQGEDQKKLDVVSNEVFSNCLRSSGRTGIIASEEEDVPVAVEESYSGNYVVVFDPLDGSSNIDAAVSTGSIFGIYSPNDECLPDSDDTSALGSEEERCIVNVCQPGNNLLAAGYCMYSSSVIFVLTLGKGVFAFTLDPMYGEFVLTQENIEIPKAGKIYSFNEGNYQMWDENLKKYIDDLKDPGPSGKPYSARYIGSLVGDFHRTLLYGGIYGYPRDAKSKNGKLRLLYECAPMSFIVEQAGGKGSDGHHRVLDIQPTEIHQRVPLYIGSKEEVEKLEKYLA

SEQ ID NO: 25159 - protein, 344 aa, Nitrobacter vulgaris
MSQELTLQQRMDGEAGSDPLRQAVKEAVAALARAAVDISDLTCRGALAGITGQAQGRNTDGDIQKDLDVRADQIIRDALGKLPIAALASEEMADLDILNPAAPICVAFDPLDGSSNINTNMSVGTIFSIMPTPSDVNAAFRQAGSAQLAAGFVVYGPQTSLVLTLGRGVDIFTLDRADRVFKLTGSSVQIPTDANEFAINASNRRHWDLPVRAYIDECLAGADGPCGKNFNMRWIGSLVAEAFRILIRGGIFLYPGDARDGYEEGRLVVYEAHPMAFIVEQAGGGASTGRKRVLDIVPDSLHQRVPLIMGSIKNVQRLEHMHTVPDVALEANAPLFGNRGLFRV

SEQ ID NO: 25160 - protein, 354 aa, Locusta migratoria
MGCAMSAEERAALARSKQIEKNLKEDGLQAAKDIKLLLLGAGESGKSTIVKQMKIIHESGFTAEDFKQYRPVVYSNTIQSLVAILRAMPNLGISFCNNERETDAKMVFDVIQRMEDTEPFSEELLAAMKRLWADSGVQECFGRSNEYQLNDSAKYFLDDLDRLGAKDYQPTEQDILRTRVKTTGIVEVHFSFKNLNFKLFDVGGQRSERKKWIHCFEDVTAIIFCVAMSEYDQVLHEDETTNRMQESLKLFDSICNNKWFTDTSIILFLNKKDLFEEKIKKSPLTICFPEYAGAQEYGEAAAYIQAQFEAKNKSTTKEIYCHMTCATDTNNIQFVFDAVTDVIIANNLRGCGLY

SEQ ID NO: 25161 - protein, 355 aa, Neurospora crassa
MCFGGRGKDDEAEASRSRELDKQIRADEKRLSKEVKLLLLGAGESGKSTILKQMKLIYAQGFSKNEKLEWRPVIFANILQSFRLIFDAMNEFNIKLEDEDNEKNMVQMMVDYEMRGDEPLPLEYFEPAKKLWQDSGVRQAIEKGNEFALHDNLQYFCSDLDRLWDRNYVPSDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 25162 - protein, 355 aa, Canis familiaris
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFDDPSRADDARQLFALSCTAEEQGVLPEDLSCVIRRLWADNGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYEEAASYIQSKFEDLNKRKDTKEIYTHFTCATDTKNVQFVFDAVTDVIIKNNLKDCGLF

SEQ ID NO: 25163 - protein, 354 aa, Loligo forbesi
MACCLSEEAKEQKRINQEIEKQLRRDKRDARRELKLLLLGTGESGKSTFIKQMRIIHGSGYSEEDRKGFEKIVYQNIFSAIQTLIAAMETLSLEYKDPSNNEHAEFLNSIDADSADIFEDGHVTAIKGCWTDPGMQECYDRRREYQLTDSAKYYLDDVERIHEPGYIPTLQDILRVRVPTTGIIEYPFDLYSIIFRMVDVGGQRSERRKWIHCFENVTSIMFLVALSEYDQVLVESDNEENRMEESKALFRTIITYPWFQNSSVILFLNKKDLLEEKIMTSHLADYFPDYDGPKCDYEAAREFMMDSYMDLNEDKEKMLYYHYTCATDTENIRFVFAAVKDTILQLNLKEYNLV

SEQ ID NO: 25164 - protein, 353 aa, Lymnaea stagnalis
MACCIPDELKEQKRINQEIERQLKRDKRDARRELKLLLLGTGESGKSTFIKQMRIIHGAGYSDEDKRSHIKIVYQNIFMAMHAMIRAMDTLNIQYINPANRENGNMIRQIDYETVTTFDKPCVDAIISLWNDDGIQECYDRRREYQLTDSAKYYLDSVERISQQDYLPTLQDILRVRVPTTGIIEYPFDLDSIIFRMVDVGGQRSERRKWIHCFENVTSIMFLVALSEYDQVLVESDNENRMEESKALFRTIITYPWFQNSSVILFLNKKDLLEEKIMHSHLVDYFPEFDGPKKEASTAREFILKMFVELNPDPDKIIYSHFTCATDTENIRFVFAAVKDTILQLNLKEYNLV

SEQ ID NO: 25165 - protein, 353 aa, Mus musculus
MACCLSEEAKEARRINDEIERHVRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPSYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 25166 - protein, 353 aa, Xenopus laevis
MACCLSEEAEEARRINDEIERQLRRDKRDARRELKLLLLGTGESGKSTFIKQMRIIHGSGYSDEDKRGFTKLVYQNIFSAMQAMIRAMETLKIPYKYEHNKGHALLVREVDVEKVASFENPYVDAIKYLWNDPGIQECYDRRREYQLSDSTKYYLNDLDRIATHGYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 25167 - protein, 350 aa, Xenopus laevis
MGAGASAEEKHSRELEKKLKEDADKDARTVKLLLLGAGESGKSTIVKQMKIIHQDGYSVEECLEFIAIIYGNTLQSMIAIVKAMNTLNIQFGDPARQDDARKLMHLADTIDEGSMPKEMSDIIGRLWKDTGIQACFDRASEYQLNDSAGYYLNDLDRLVIPGYVPTEQDVLRSRVKTTGIIETQFGLKDLNFRMFDVGGQRSERKKWIHCFEGVTCIIFIAALSAYDMVLVEDDEVNRMHESLHLFNSICNHRYFATTSIVLFLNKKDVFTEKIKKAHLSICFPDYDGPNTYEDAGNYIKTQFLELNMRRDVKEIYSHMTCATDTENVKFVFDAVTDIIIKENLKDCGLF

SEQ ID NO: 25168 - protein, 1344 aa, Oryza sativa (indica cultivar-group)
MSQHYTKTICIAVVLVAVLFSLSSSAAAGSGAAVSVQLEALLEFKNGVADDPLGVLAGWRVGKSGDGAVRGGALPRHCNWTGVACDGAGQVTSIQLPESKLRGALSPFLGNISTLQVIDLTSNAFAGGIPPQLGRLGELEQLVVSSNYFAGGIPSSLCNCSAMWALALNVNNLTGAIPSCIGDLSNLEIFEAYLNNLDGELPPSMAKLKGIMVVDLSCNQLSGSIPPEIGDLSNLQILQLYENRFSGHIPRELGRCKNLTLLNIFSNGFTGEIPGELGELTNLEVMRLYKNALTSEIPRSLRRCVSLLNLDLSMNQLAGPIPPELGELPSLQRLSLHANRLAGTVPASLTNLVNLTILELSENHLSGPLPASIGSLRNLRRLIVQNNSLSGQIPASISNCTQLANASMSFNLFSGPLPAGLGRLQSLMFLSLGQNSLAGDIPDDLFDCGQLQKLDLSENSFTGGLSRRVGQLGNLTVLQLQGNALSGEIPEEIGNLTKLISLKLGRNRFAGHVPASISNMSSLQLLDLGHNRLDGMFPAEVFELRQLTILGAGSNRFAGPIPDAVANLRSLSFLDLSSNMLNGTVPAALGRLDQLLTLDLSHNRLAGAIPRRATCRCTSTCRTTRSRARSPAEIGGLVMVQTIDLSNNQLSGGVPATLAGCKNLYSLDLSGNSLTGELPANLFPQLDLLTTLNISGNDLDGEIPADIAALKHIQTLDVSRNAFAGAIPPALANLTALRSLNLSSNTFEGPVPDGGVFGNLTMSSLQGNAGLCGGKLLVPCHGHAAGNKRVFSRTGLVILVVLIALSTLLLLMVATILLIGYRRYRRKRRAAGIAGDSSEAAVVVPELRRFSYGQLAAATNSFDQGNVIGSSNLSTVYKGVLAGDADGGMVVAVKRLNLEQFPSKSDKCFFTELATLSRLRHKNLARVVGYAWEAGKIKALVLDYMVNGDLDGAIHGGAAAPPTAPSRWTVRERLRVCVSVAHGLVYLHSGYDFPVVHCDVKPSNVLLDGDWEARVSDFGTARMLGVHLPAAADAAAQSTATSSAFRGTVGYMAPVISELKTSNSVLKKFRVRVHEDGVDEGGRVQLRGAGDGALHRAAADGDDRGGRRAADAAAAGRQRGLEGARRRPRRPGPPHEGRHRGRPVHGGGRARRCPVLRRVRAGRPARHGRCALVLAQDEQARRRRLNKKKKKRKAKLSLQFCRMQQRKHSSQNFHVYCAIVKSSAILHNAAVKTCKFLGRFRVQFMMIWFFEFFALRTFSIDEVYYLFATVHGQGSVRHGSEVVPKFLPFDPPKTFRAATYLYAQALQVRMEAERLKDSTELKTIYYSSCMSANKSGELITNMLT

SEQ ID NO: 25169 - protein, 331 aa, Oryza sativa (indica cultivar-group)
MEANLPPGFRFHPRDEELIVDYLYHKLSGGGGGGGAGEFYGGVAMVDVDLNKCEPWELPAYFLHNLIIFPARARARAAGRRRRADAARVGATEWYFFSLHDRKYATGQRTNRATRSGYWKATGKDRAIVTRRRAAGGEAVAGGEVVGMRKTLVFYQGRAPRGSKTEWVMHEFRVDGHAVADHPSSSTSSSSSNLLKEDWVLCRVFYKSRTANPRPVVSGEAAVSLSGELSLPPPPPLPVAPAVIDGYTGGGYYEQDSSAGCHHHHHRPPTSAALPFKDLTDFRDLLSNMVQGGGAAAAAAKSEGFHLGWSEEESSGYVQQSAMASQAWNPF

SEQ ID NO: 25170 - protein, 497 aa, Fundulus heteroclitus
MWFYNLLLSLDVKGLFLFIFLFLLIADFYKSRKPANFPPGPKALPFVGNFFSLDSKHPHVYFQKLAEIYGNVFSFRLGRDSIVFLNGYKAVREALVTQAENFVDRPFNAITDRFYTEPSAGIFMSNGEKWKKQRRFALSTLRNFGLGKNSLEQSVSEEIQHLQEEMEIEKGKPFNPSGLFTNAVSNIICQLVMGKRYDYTDHRFQMMLRCMSEAVLLEGNVWGQLYMAFPSVMRYMPGPHNKIFSHFSSVEQFLYEEVEQHKKDLDRDNPRDYIDTFLIEMENHKESDLGFTEANLVYCAIDLFLAGTETTATTLLWALVFLVKYPEVQEKVQAEIDSVIEQARLPSMADRSSMPYTDAVIHEIQRIGNILPLNGMRVAAKDTTLGGYFIPKGTSLMPVLTSVLFDKAEWACPDTFNPGHFLDDNGKFVKRDAFLPFSAGKRACIGESLAKMELFLFLVALLQKFTFSVPEGVELSTEGITGTTRVPHPYKVSAKIR

SEQ ID NO: 25171 - protein, 747 aa, Mus musculus
MDIASPPTSKCITYWKRKVKSEYMRLRQLKRLQANMGAKALYVANFAKVQEKTQILNEEWKKLRVQPVQPMKPVSGHPFLKKCTIESIFPGFDSQDMLMRSLNTVALVPIMYSWSPLQQNFMVEDETVLCNIPYMGDEVKEEDETFIEELINNYDGKVHGEEEMIPGSVLISDAVFLELVDALNQYSDEEEDGHNDPSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHPVVSASCSNASASAMAETKEGDSDRDTGNDWASSSSEANSRCQTPTKQKASPAPAQLCVVEAPSEPVEWTGAEESLFRVFYGTYFNYFCSIARLLGTKTCKQVFQFAVKESLILKLPTDELMNPAQKKKRKHRLWAAHCRKIQLKKDNNSTQVYNYQPCDHPDRPCDSTCPCIMTQNFCEKFCQCSPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVF

SEQ ID NO: 25172 - protein, 491 aa, Gallus gallus
MEGPGAAAAAVGAGPGGSNVSAFLTKLWTLVEDPETDPLICWSPSGNSFHVFDQGQFAKEVLPKYFKHNNMASFVRQLNMYGFRKVVHIEQGGLVKPEKDDTEFQHPYFIRGQEHLLENIKRKVTSVSSIKNEDIKVRQDNVTKLLTDIQVMKGKQESMDSKLIAMKHENEALWREVASLRQKHAQQQKVVNKLIQFLISLVQSNRILGVKRKIPLMLNDSSSAHSMPKYSRQYSLEHVHGSSPYAASSPAYSGSNIYSPDSSTNSGPIISDVTELAQSSPSASPSGSLDERSSPVVRIKEEPPSPSRSPKENEPSTTTAAAGNSTEQPQPQEKCLSVACLDKNELNDHLDTIDSNLDNLQTMLSTHGFSVDTTALLDLFSPSMTVTDMNLPDLDSSLASIQDLLSSQEQQKPSEADAAAADTGKQLVHYTAQPLFLVDSSAVDVGSGDLPIFFELGEGSYFTDGDEYNEDPTISLLSGTEQPKPKDPTVS

SEQ ID NO: 25173 - protein, 564 aa, Gallus gallus
MKQEPQQQQPAQQPPPAGAGVPAFLSKLWALVGEAPSNQLITWSQNGQSFLVLDEQRFAKEILPKYFKHNNMASFVRQLNMYGFRKVVHVDSGIVKLERDGLVEFQHPYFKQGREDLLEHIKRKVSSSRPEENKISQEDLSKIISSAQKVEIKQETIESRLSALKRENESLWREVAELRAKHLKQQQVIRKIVQFIVTLVQNNQLVSLKRKRPLLLNTNGPTKSNVFQQIVKEPADNNNHVPLNRTEGLKQREQISDDIIIYDVTEDVADEENTMVDEENAPITPETNEDTTSDSSNCSRSPDIVIVEDDNEEEYAPVIQGDKSTESVAVSANDPLSPVSDSTSPLMSSAVQLNNQSTLTAEDPVSMMDSILNENGVISQNINLLGKVELLDYLDSIDCSLEDFQAMLSGRQFSIDPDLLFDLFTSSVQMNPTDHIPNTKMETKGIETTKSNAGPAASQETQVSKPKSDKQLIQYTAFPLLAFLDGNPGSTVESGSSATETPSSVDKPLEVDELLESSLDPEPTQSKLVRLEPLTEAEASEATLFYLCELAPAPMDTDMPFLDN

SEQ ID NO: 25174 - protein, 467 aa, Gallus gallus
MREGSALPGAPGAAPVPGFLAKLWALVEDPQSDDVICWSRNGENFCILDEQRFAKELLPKYFKHNNISSFIRQLNMYGFRKVVALENGMITAEKNSVIEFQHPFFKQGNAHLLENIKRKVSAVRTEDLKVCAEDLHKVLSEVQEMREQQNNMDIRLANMKRENKALWKEVAVLRQKHSQQQKLLSKILQFILSLMRGNYIVGVKRKRSLTDAAGASPSKYSRQYVRIPVESGQAMAFSEHNSDDEDGNRTGLIIRDITDTLENATNGLLAVAHTSGRDRETQTALDPGLPICQVSQPNELSCAEPIPPVHINDVSKPNEMGNVAVELHTAQANAPEDPVSVIDSILNENNSGNQNDPLLDREEIQDFLNCIDASLEELQAMLSGKQYSFGSEAFSDVFNPELPALDMNLMETSPGMENIANMEDSTEDLGASERETAGSKGGQEGTESCDSSVLFQNCVLKWNFSSL

SEQ ID NO: 25175 - protein, 135 aa, Trypanosoma cruzi
MATPKQAAKKASKKRSGGRSAKAGLIFPVGRVGSLLRRGQYARRIGASGAVYMAAVLEYLTAELLELSVKAASQQAKKPKRLTPRTVTLAVRHDDDLGTLLKDVTLSRGGVMPSLNKALAKKHKSSKKARATPSA

SEQ ID NO: 25176 - protein, 536 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNRLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHLHQLHVCLPSSKNKTRLLYRMSLDFAPILKNLPFMEHLWRHFAEQVLNEDLRLVLGQQERMLNGANIWNLPVAYDKLGVRYRLWRNAVDRGDDKLPFSG

SEQ ID NO: 25177 - protein, 253 aa, Erwinia chrysanthemi
MILNTFNLQGKVALITGCDTGLGQGMAVGLAEAGCDIVGVNIVEPKETIEKVTAVGRRFLSLTADMSDISGHAALVEKAVAEFGKVDILVNNAGIIRREDAIEFSEKNWDDVMNLNIKSVFFMSQTVARQFIKQGHGGKIINIASMLSFQGGIPVPSYTASKKRVMGITRIVANEWAKHNINVNAIAPGYMATNNTQHVRADQDRSKEILDRIPAGRWGLPQDLQGPAVFLASSASDYVNGYTIAVDGGWLAR

SEQ ID NO: 25178 - protein, 394 aa, Pisum sativum
MEGGGGAPAADAVMEDAAPQQQEPQQQAAMGIENIPATLSHGGRFIQYNIFGNIFEVTAKYRPPIMPIGKGAYGIVCSAHNSETNEHVAVKKIANAFDNKIDAKRTLREIKLVRHMDHENVVAIRDIVPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRQRITVENALAHPYLTSLHDISDEPVCTTPFSFDFEQHALTEEQMKELIYREALAFNPEYQQ

SEQ ID NO: 25179 - protein, 387 aa, Medicago sativa
MEGGGAPPADTVMSDAAPAPPQMGIENIPAVLSHGGRFIQYNIFGNIFEVTAKYKPPIMPIGKGAYGIVCSAHNSETNEHVAVKKIANAFDNKIDAKRTLREIKLLRHMDHENVVAIRDIVPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEDDLGFLNENAKRYIRQLPPYRRQSFQEKFPHVHPEAIDLVEKMLTFDPRKRITVEDALAHPYLTSLHDISDEPVCMTPFSFDFEQHALTEEQMKELIYREALAFNPEYQQ

SEQ ID NO: 25180 - protein, 885 aa, Entamoeba histolytica
MQRVYAFEDGDGTNKKLLGGKGAGLCTMTKIGLPVPQGFVITTEMCKQFIANGNKMPEGLMEEVKKEYQLVEKKSGKVFGGEENPLLVSVRSGAAMSMPGMMDTILNLGLNDKTVVALAKLTNNERFAYDSYRRFVSLFGKIALNACDEVYDKTLENKKVEKGVKLDTELDANDMKELAQVFIKKTEEFTKQPFPVDPYAQLEFAICAVFRSWMGKRAVDYRREFKITPEQADGTAVSVVSMVYGNMGNDSATGVCFTRDPGTGENMFFGEYLKNAQGEDVVAGIRTPQIISKMAEDRDLPGCYEQLLDIRKKLEGYFHEVQDFEFTIERKKLYMLQTRNGKMNATATVRTGVDMVEEGLITKEQAIMRIAPQSVDQLLHKNMPANYAEAPLVKGLPASPGAATGAVVFDADDAVEQAKGKKVLLLREETKPEDIHGFFVAEGILTCRGGKTSHAAVVARGMGKPCVSGAEGIKVDVAKKIAKIGSLEVHEGDILTIDGSTGCVYKGEVPLEEPQVGSGYFGTILKWANEIKKIGVFAAGDLPSAAKKALEFGAEGIGLCRTERMFNAVERLPIVVKMILSNTLEERKKYLNELMPLQKQDFIGLLKTMNGLPVTVRLLDPPLHEFLPTLEELMREIFEMKLSGKTEGLAEKEVVLKKVKELMEVNPMIGHRGIRLGTTNPEIYEMQIRAFLEATREVIKEGINDHREIMIPNVTEVNELINLRKNVLEPVHEEVEKKYGIKVPFSYGTMVECVRAALTADKIATEASFFSFGTNDLTQGTFSYSREDSENKFIPKYVELKILPANPFEILDRPGVGEVMRIAVTKGRQTRPELLVGICGEHGGEPSSIEWCHMIGLNYVSCSSYRIPVARIAAAQAQIRHPREN

SEQ ID NO: 25181 - protein, 384 aa, Synechococcus sp. PCC 7942
MTQATELLDPALKPAETKAKRSSRKKATTAVVEPATTIAPTADVDAIDDEDSVGEDEDAAAKAKAKVRKTYTEDSIRLYLQEIGRIHPAASQQQRPTRRRWANDRAVRATHRECVLEQASQRFDGRAQFLHRPAATEFRRRLFRGRRAKDKMVQSNLRLVVSIAKKYMNRGLSFQDLIQEGSLGLIRAAEKFDHEKGYKFSTYATWWIRQAITRAIADQSRTIRLPVHLYETISRIKKTTKLVSQEMGRKPTEEEIATRMEMTIEKLRFIAKSAQLPISLETPIGKEEDSRLGDFIEADGETPEDEVAKNLLREDLEGVLSTLSPRERDVLRLRYGLDDGRMKTLEEIGQLFNVTRERIRQIEAKALRKLRHPNRNSILKEYIR

SEQ ID NO: 25182 - protein, 295 aa, Myxococcus xanthus
MQASNSFSSPDSLSTYLSEINQYPLLTQPQEQELSKRFRAGDLAAGHQLVTANLRFVVKVAYEYRSYGLKMSDLIQEANIGLMKAVQKFDPDKGIRLISYAVWWIRAYIQNCILKNWSLVKLGTTQAQRRLFFSLARTRRELEKMGAGDANVVNAEEIARKLNVKASEVREMEQRMGGRDLSLDAPMGEDGDATHLDFVESESVSAVDEVADRQQANLTRELVQRALRRLDPRERFIIEQRVMGDAEMTLSELGEHFGFSRERARQLEIRAKDKLKLALVTLMAEAGVDESTLNA

SEQ ID NO: 25183 - protein, 277 aa, Beta vulgaris
  unsure (1)..(277): unsure at all Xaa locations
EDLQLLPKILTWCRXIHLFVGVVYCLISWTVGLPKRAPIDGTLLKLLIPVAVCHALGHVTSNVSFAAVAVSFTHTVKALEPFFNAAASQFILGQPIPITLWLSLAPVVIGVSMASLTELSFNWLGFISAMISNISFTYRSIYSKKAMTDMDSTNIYAYISIIALFVCLPPAIIVEGPQLIKHGFNDAITKVGLTKFVSDLFWVGMFYHLYNQLATNTLERVAPLTHAVGNVLKRVFVIGFSIIIFGNKISTQTAIGTSIAIAGVAIYSFIKAKMEEE

SEQ ID NO: 25184 - protein, 501 aa, Vitis vinifera
MAVPGGHRQRGRPRALIGEPVRPRVPLRRLLRVASVACGIQFGWALQLSLLTPYVQELGIPHAWSSIIWLCGPLSGLLVQPLVGHLSDRCNSRFGRRRPFIVAGATSIVVAVLIIGFSTDIGGLLGDGADRRPRAVATFVVGFWLLDVANNVTQGPCRALLADLTEKDHRRTRVANAYFSLFIAVGNVLGFATGSYSGWFRIFWFTSTSSCNADCANLKSAFLLDIIFIAITTYISITAAQELPLSSSSRSTHISEEMAESTHAQEAFLWELFGTLRYLSGSIWIILFVTALTWIGWFPFLLFDTDWMGREIYGGKPNEGQNYNTGVRMGALGLMLNSVVLGITSVLMEKLCRKWGAGFVWGLSNILMSLCFLLMLILSAVVKHMDFLGHDLPPSGVVIAALIVFSILGIPLAITYSVPYALISTRIESLGLGQGLSMGVLNLAIVIPQVIVSLGSGPWDQLFGGGNSPSLAVAAVAAFASGLVAILAIPRSSADKSRVHT

SEQ ID NO: 25185 - protein, 810 aa, Drosophila melanogaster
MTDKKNEIQPAAEPVAEPEPSPAAEIAPASPDGSGPSAAAAEEVTPSVATVEDTTPIAAPAESQPSGESNGTAEAKKLPEIAKKNGKEPDQNDKEPDQNGKELAETNDFKNVSETEGQQKKLPYPKSVFFIISNEFCERFNYYGMRTVLVLYLSRVLGYSDDTATVVFHIFTMFVYFLCVFGAIISDSWLGKFKTILYLSLVYICGSVLLTLGAIGRLNLPMETFTMLGLALIALGSGGIKPCVSAFGGDQFKVPEQVKQITSFFSLFYFSINAGSLISTTVTPILREDVSCFDDINCYPLAFGVPAVLMIVSVIIFVLGRSLYKMKPPAGNMVVLVSSTIWTALTTKCKEKKTNPREHWLDYADKKYDRQLIDDVKVLMRVLFLYLPLPVFWALFDQQGSRWTFQATRMDGDMGSWDIKPDQLQVLNPLLILIFIPLYDVALYPALKLVGIRRPLQKLTMGGILAGIAFIISGVVELSLEKTYPDLPYSQNIQLRIFNADNCDYFFTSNIPGAENVTVTSLNAYTNKDIYAPGSLDVEFSLSSASEACTISADKIPKVLTDNTAWSLFLNPLNGSGYYWEEDFVDKPSQSHPLIRNVANVPQELSIRWEKASTGEVVYDDLASKTLLTRVNSAEYVVMVGERNVGTFDVHTGGVYTLLIKDNNNIYEANLEEVTSPNSVKILWLVPQYVVMTLGEVMFSVTGLEFSYAQAPPSMKSVLQACWLLTVAFGNVIVVVIAEAALFESQASEFFLFAGLMFADMLIFMVMAYYYVPNDPNKVEEAQPLTAGDAKTEIPALEGGVENKGKDINE

SEQ ID NO: 25186 - protein, 180 aa, Homo sapiens
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSI

SEQ ID NO: 25187 - protein, 299 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSPSGNGCKNEKLFNGEFTKTE

SEQ ID NO: 25188 - protein, 259 aa, Helianthus annuus
MAAASSPREENVYLAKLAEQAERYEEMVEFMEKVVAAADGGEELTIEERNLLSVAYKNVIGARRASWRIISSIEQKEESRGNEGHVSTIRDYRSKIESELSSICDGILKVLDSKLIGSASGGDSKVFYLKMKGDYYRYLAEFKTGDERKLAAENTLSAYKAAQDIANAELAPTHPIRLGLALNFSVFYYEILNSPDRACNLAKQAFDEAIAELDTLGEDSYKDSTLIMQLLRDNLTLWTSDMQDDTAEEVKEAPKPDDQ

SEQ ID NO: 25189 - protein, 374 aa, Mus musculus
MGTAGKVIKCKAAVLWGVNQPFSIEEIEVAPPKAKEVRVKILATGICRTDDHIIKGSMVSKFPVIVGHEAVGVVESVGEGVTTVRPGDKVIPLFLPQCRECNACLNPEGNLCIRSDLTGCGVLADGTTRFTCKGKPVQHFMNTSTFTEYTVLDESSVAKVDGAAPPEKACLIGCGFSTGYGAAVKTAKVTPGSTCVVFGLGGVGLSVIMGCKAAGASRIIGIDINKDKFQKALAVGATECISPKDSTKPISEVLSDMTGNTVQYTFEVIGRLETMVDALSSCHMNYGTSVVVGAPPSAKMLTYDPMLLFTGRTWKGCVFGGWKSRDDVPKLVTEFLEKKFDLDQLITHTLPFNNINEGFELLYSGKSIRTVLTF

SEQ ID NO: 25190 - protein, 375 aa, Geomys bursarius
MSTAGKVIKCRAAVLWEKNKPFSIEEVEVAPPKAYEVRIKIVATGICRSDDHVVNGSIITPLPAILGHEAGGIVESIGEGVTTVKPGDKVIPLFVPQCGKCRACKHPESNLCKHGDLGRAQGTLMDGTSRFTCKGKPIHHFLGVTTFSEYTVVSEISVTKIDATSPLEKVCLIGCGFSTGYGSAVKVGKVARGSICSCVWSGRVGLSAIIGCKAAGAARIIAVDINKDKFAKAKELGATECVNPQDYDKPIYQVLQEMTDGGVDFSFEVIGRLDTMVSALMCCQESHGVSVIVGVPPNAQSLTMDPMVLLSGRSWKGAVFGGYKGKDDVPKLVADFMAKKFPLEPLITNVFPFAKINEGFDLLRAGKSIRTVLTF

SEQ ID NO: 25191 - protein, 375 aa, Gadus morhua
ATAGQVIKCKAAVAWEAGKPLSLEEVEVAPPRAGEVRIKVVATGVCHTDAYTLSGSDPEGAFPVILGHEGAGLVESVGEGVTKFKAGDTVIPLYVPQCGECKFCKNPKTNLCQKIRVTQGRGLMPDNTSRFTCKGKQLFHFMGTSTFSEYTVVADISLANVDPKAPLDKVCLLGCGISTGYGAALNTAKVEPGSTCAVFGLGAVGLAAIMGCKVAGATRIIGVDINPEKFGKAAEFGATECLNPKDHARPVQEVLVEMTDGGVDYSFECIGNVEIMRSALEACHKGWGESVIIGVAGAGQEIATRPFQLVTGRVWKATAFGGWKSVESVPKLVEDYMNKKLKVDEFVTHTLPFDSINEGFDLMHAGKSIRCVLTF

SEQ ID NO: 25192 - protein, 375 aa, Gadus morhua
ATVGKTIRCRAAVAWEAGKPLSMEEVEVAPPQAGEVRIKIVATGICHTDAYTLSGSDPEGVFPSVLGHEGAGIVESVGEGVTKFKSGDAVIPLYVPQCGECKFCKNPKTNLCQKIRLTQGKGLMPNGTSRFSCNGQVLFHFMGSSTFSEYTVVAEISLAKVHEKAPLDKVCLLGCAISTGYGAALNTAKVEAGSTCAVFGLGALGLAVIMGCQAAGASRIIAIDVNPDKFRIAKEFGATDLVNPKDHSKPVEQVLVEMTDGGVDYSFECVGNIAVMRAALEACHKGWGTSVIIGVAAAGQEISTRPFQLVTGRTWKGTAFGGYKSVESVPKLVEEYMNKKVKVDEFVTHTLPFEKIHEGFDLMGAGKSIRTVLNY

SEQ ID NO: 25193 - protein, 376 aa, Sparus aurata
METAGKVIKCKAAVAWEPGKPLSIEEVEVAPPNAHEVRIKLFATGVCHTDAYTLSGSDPEGLFPVILGHEGAGTVESVGEGVTKFKPGDTVIPLYVPQCGECKFCKNPKTNLCQKIRITQGQGLLPDKTSRFTCKGKQVFHFMGTSTFSEYTVVADISLAKVNEKAPMDKVCLLGCGISTGYGAALNTAKVEPGSTCAVFGLGAVGLAVIMGCKVAGATRIIGIDLNPAKFETAKEFGATEFVNPKDHSKPIQEVLVEMTDGGVDYSFECIGNVQIMRAALEACHKGWGESVIIGVAGAGQEISTRPFQLVTGRVWKGTAFGGWKSVESVPKLVEDYMSKKLKVDEFVTHTLPFEKINEGFELMHAGKSIRTVLTF

SEQ ID NO: 25194 - protein, 284 aa, Methylovorus sp. SS1
MTNALTIPSVSSLDSLDQYLRTIKAFPVLSVEEEYDLATRLRKGTDIEAAKGLIVSHLRLVASIARGYSGYGLPQADLIQEGNVGLMKAVRRFDPDRGVRLVSFAMHWIKAEIHEYIVRNWRLVKVATTKAQRKLFFNLRSMKKNSHTLSPAEVADIARELRVKPEEVVEMESRMGGHEISLEGNSDDDTEDNFSPIAYLEDQQPEPSELLAEREAEHNQTVGLAHALESLDERSRRIVQARWLQENNSATLHDLAAEFGVSAERIRQIEQKAMQKMKGMLSAA

SEQ ID NO: 25195 - protein, 324 aa, Plasmodium falciparum
MENNSTERYIFKPNFLGEGSYGKVYKAYDTILKKEVAIKKMKLNKISNYIDDCGINFVLLREIKIMKEIKHKNIMSALDLYCEKDYINLVMEIMDYDLSKIINRKIFLTDSQKKCILLQILNGLNVLHKYYFMHRDLSPANIFINKKGEVKLADFGLCTKYGYDMYSDKLFRDKYKKNLNLTSKVVTLWYRAPELLLGSNKYNSSIDMWSFGCIFAELLLQKALFPGENEIDQLGKIFFLLGTPNENNWPEALCLPLYTEFTKATKKDFKTYFKIDDDDCIDLLTSSLKLNAHERISAEDAMKHRYFFNDPLPCDISQLPFNDL

SEQ ID NO: 25196 - protein, 162 aa, Ciona intestinalis
MANCKVFVGNLSYNATEDDLRKHFSGSGQVEEVAIICDRETGRSRGFAFVTFSSEGEANDAIENLNESDVRGRNVSVRQAQSKRDGGGGGRGGGGYGGGGYGGGGGYGGGGGYGGGGGGGGRYGGSSGYGGGGRRYNDDRGSYGGGDYGGERSGGGGRSDRY

SEQ ID NO: 25197 - protein, 341 aa, Homo sapiens
MAAVSGLVRRPLREVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 25198 - protein, 330 aa, Pectobacterium carotovorum
MSQSTLKVNELHEETDFDENGLDVFDDKALAEEDTNDSDSAEDELLSQGVPQRVLDATQLYLGEIGYSPLLTAEEEVYFARRALRGDIPSRRRMIESNLRLVVKIARRYNNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVNRMLRLNERITSVDTPLGGDSEKALLDILADEKDNGPEDTTQDNDMKQNIVKWLFELNAKQREVLARRFGLLGYEAATLEDVGREIGLTRERVRQIQVEGLRRLREILQVQGLSIEELFRE

SEQ ID NO: 25199 - protein, 375 aa, Geomys knoxjonesi
MSTAGKVIKCRAAVLWEKNKPFSIEEVEVVPPKAYEVRIKIVATGICRSDDHVVNGSIITPLPAILGHEAGGIVESIGEGVTTVKPGDKVIPLFVPQCGKCRACKHPESNLCTHGDLGRAQGTLMDGTSRFTCKGKPIHHFLGVTTFSEYTVVSEISVTKIDAASPLEKVCLIGCGFSTGYGSAVKVGKVARGSICSCVWSGRVGLSAIIGCKAAGAARIIAVDINKDKFAKAKELGATECVNPQDYDKPIYQVLQEMTDGGVDFSFEVIGRLDTMVSALMCCQESHGVSVIVGVPPNAQSLTMDPMVLLSGRSWKGAVFGGYKGKDDVPKLVADFMAKKFPLEPLITNVFPFAKINEGFDLLRAGKSIRTVLTF

SEQ ID NO: 25200 - protein, 374 aa, Rattus norvegicus
MDTAGKVIKCKAAVLWGTNQPFSIEDIEVAPPKAKEVRVKILATGICGTDDHVIKGTMVSKFPVIVGHEAVGIVESVGEEVTTVRPGDKVIPLFLPQCRECNPCRNPEGNLCIRSDLTGRGVLADGTTRFTCKGKPVQHFMNTSTFTEYTVLDESSVAKIDAEAPPEKACLIGCGFSTGYGAAVKTAKVSPGSTCAVFGLGGVGLSVVMGCKAAGASRIIGIDINKDKFQKALDVGATECINPRDFTKPISEVLSDMTGNTVQYTFEVIGRLETMVDALSSCHMNYGTSVVVGAPPSAKMLSYDPMLLFTGRTWKGCVFGGWKSRDDVPKLVTEFLEKKFDLGQLITHTLPFHNISEGFELLYSGQSIRTVLTF

SEQ ID NO: 25201 - protein, 516 aa, Gentiana triflora
MSPIYTTLTLHLATALFLFFHVQKLVHYLHGKATGHRCRRLPPGPTGWPILGALPLLGNMPHVTFANMAKKYGSVMYLKVGSHGLAIASTPDAAKAFLKTLDLNFSNRPPNAGATHLAYNAQDMVFAHYGPKWKLLRKLSNLHMLGGKALENWADVRKTELGYMLKAMFESSQNNEPVMISEMLTYAMANMLSQVILSRRVFNKKGAKSNEFKDMVVELMTSAGYFNIGDFIPSIGWMDLQGIEGGMKRLHKKFDVLLTRLLDDHKRTSQERKQKPDFLDFVIANGDNSDGERLNTDNIKALLLNLFTAGTDTSSSIIEWALAELLKNRTLLTRAQDEMDRVIGRDRRLLESDIPNLPYLQAICKETFRKHPSTPLNLPRNCIRGHVDVNGYYIPKGTRLNVNIWAIGRDPSVWGDNPNEFDPERFLYGRNAKIDPRGNHFELIPFGAGRRICAGTRMGILLVEYILGTLVHSFDWKLGFSEDELNMDETFGLALQKAVPLAAMVIPRLPLHVYAP

SEQ ID NO: 25202 - protein, 510 aa, Eustoma grandiflorum
MAVGNGVLLHIARSLMLFFHVQKLVQYLWMNSRRHRLPPGPIGWPVLGALPLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANRDNSEGERLHTVNIKALLLNMFTAGTDTSSSVIEWALAELLKNPIILKRAQEEMDGVIGRDRRFLEADISKLPYLQAICKEAFRKHPSTPLNLPRIASQACEVNGHYIPKGTRLSVNIWAIGRDPSLWENPNEFNPDRFLERKNAKIDPRGNDFELIPFGAGRRICAGTRLGILLVEYILGTLVHSFDWELPSSVIELNMDEPFGLALQKAVPLAAMVTPRLPLHIYCP

SEQ ID NO: 25203 - protein, 523 aa, Campanula medium
MSIDISTLFYELVAAISLYLATYSFIRFLFKPSHHHHLPPGPTGWPIIGALPLLGTMPHVSLADMAVKYGPIMYLKLGSKGTVVASNPKAARAFLKTHDANFSNRPIDGGPTYLAYNAQDMVFAEYGPKWKLLRKLCSLHMLGPKALEDWAHVKVSEVGHMLKEMYEQSSKSVPVPVVVPEMLTYAMANMIGRIILSRRPFVITSKLDSSASASASVSEFQYMVMELMRMAGLFNIGDFIPYIAWMDLQGIQRDMKVIQKKFDVLLNKMIKEHTESAHDRKDNPDFLDILMAATQENTEGIQLNLVNVKALLLDLFTAGTDTSSSVIEWALAEMLNHRQILNRAHEEMDQVIGRNRRLEQSDIPNLPYFQAICKETFRKHPSTPLNLPRISTEACEVDGFHIPKNTRLIVNIWAIGRDPKVWENPLDFTPERFLSEKHAKIDPRGNHFELIPFGAGRRICAGARMGAASVEYILGTLVHSFDWKLPDGVVEVNMEESFGIALQKKVPLSAIVTPRLPPSSYTV

SEQ ID NO: 25204 - protein, 510 aa, Eustoma grandiflorum
MAVGNGVLLHIAASLMLFFHVQKLVQYLWMNSRRHRLPPGPIGWPVLGALRLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANGDNSEGERLQTVNIKALLLNMFTAGTDTSSSVIEWALAELLKNPIILRRAQEEMDGVIGRDRRFLEADISKLPYLQAICKEAFRKHPSTPLNLPRIASQACEVNGHYIPKGTRLSVNIWAIGRDPSVWENPNEFNPDRFLERKNAKIDPRGNDFELIPFGAGRRICAGTRLGILLVEYILGTLVHSFVWELPSSVIELNMDESFGLALQKAVPLAAMVTPRLPLHIYSP

SEQ ID NO: 25205 - protein, 542 aa, Sinapis alba
MNTFTSNSSDLTSTTKQTLSFSNMYLLTTLQAFVAITLVMLLKKVLVNDTNKKKLSLPPGPTGWPIIGMVPTMLKSRPVFRWLHSIMKQLNTEIACVRLGSTHVITVTCPKIAREVLKQQDALFASRPMTYAQNVLSNGYKTCVITPFGEQFKKMRKVVMTELVCPARHRWLHQKRAEENDHLTAWVYNMVNNSDSVDFRFVTRHYCGNAIKKLMFGTRTFSQNTAPNGGPTAEDIEHMEAMFEALGFTFSFCISDYLPILTGLDLNGHEKIMRDSSAIMDKYHDPIIDARIKMWREGKKTQIEDFLDIFISIKDEEGNPLLTADEIKPTIKELVMAAPDNPSNAVEWAMAEMVNKPEILRKAMEEIDRVVGKERLVQESDIPKLNYVKAILREAFRLHPVAAFNLPHVALSDATVAGYHIPKGSQVLLSRYGLGRNPKVWADPLSFKPERHLNECSEVTLTENDLRFISFSTGKRGCAAPALGTALTTMLLARLLQGFTWKLPENETRVELMESSHDMFLAKPLVMVGELRLPEHLYPTVK

SEQ ID NO: 25206 - protein, 501 aa, Solanum chacoense
MQLISIFLFICFLFLLRKWKKYSKNSQTKKLPPGPWKLPFIGSMHHLAGGRPHRVLRDLAKKYGPLMHLQLGEVSAVVVTSPDMAKEVLKTHDIAFASRPKLLAMDIICYDRCDIAFSPYGEYWKQMRKICVTEVLSAKSVRSFSSIRCDEVVRLIDSIQSSSSSGELVNFKERVIWFTSSMTCRSAFGQLPKEQDMFIKLIREVIRLAEGFDVADIFPSYKFLHVFGRAKRKLLNVHRKVDAIVEDVINEHKKNFATRKNDDHALGGENLIDVLLKLMNDKSLQFPINNDNIKAIIIDMFAAGTETSSTTTVWAMVEMLKNPRVLAKAQAEVREAFRNKVTFDENDVEDLKYLKLVIKETMRLHAPIPLLVPRECRKETEINGYTIPVKTKVMVNVWALGRDPKYWDDVECFKPERFEQCSIDFIGNNFEYLPFGGGRRICPGTSFGLANDYLPLAQLLCHFDWKLPTGMEPKDLDLTELAGMSAASKDDLYLIATPYQP

SEQ ID NO: 25207 - protein, 752 aa, Chlamydomonas reinhardtii
MDKAERAAGGPNAASEDDWLLEFWPEPAADFPAPVAPMLSQHQDAAQLPEAMPQQQGLALGGYGLTQQPSDFMQTGMPGFDAFSSGKAATLGLPLLADPQRASTDGASALMNAAQQSSEYMLAPGMGGMPHLLAPSVGTALPGTGHTGFADLSMGGMAGGIPGLGGPGIMHGQYFMQPQRAATGPAKSRLRWTPELHNRFVNAVNSLGGPDKATPKGILKLMGVDGLTIYHIKSHLQKYRLNIRLPGESGLAGDSADGSDGERSDGEGGVRRATSLERADTMSGMAGGAAAALGRAGGTPGGALISPGLAGGTSSTGGMAAGGGGGGGLVTEPSISRGTVLNAAGAVATAAPAAAAPAGGSAAVKRPAGTSLSSGSTASATRRNLEEALLFQMELQKKLHEQLETQRQLQLSLEAHGRYIASLMEQEGLTSRLPELSGGAPAAAPVAAGGAAGGMIAPPPPQQQLQHQPQLLQPQGSLPAGGSSEAHAAAGAGTMVVHQQQQQHVHHHHQQQQVQMQQHARHCDTCGAGGAGGAPSGGSSMQQLQAAEQQRTELVVAGRLGSMPAPASSSPLAGQAHQQQPLAGGAAHLVHVHSHTPGGQPHVQHQDAFAGAATAAAHASPGLPQSHSHLLPADLSSNAGPDTSAGQIKPEPDMSQQQQQQEQQEAEQLAQGLLNDSSAGAGAVSGSDGGGLGDFDFGDFGDLDGGAQGGLLGPGDLIGIAELEAAAAHEQQQEQEHDPLDADRAKRQRVEP

SEQ ID NO: 25208 - protein, 711 aa, Lycopersicon esculentum
MVALGCFLFFLVSFCSFSPSYFALSDIEAASIARRQLLSNNGQLSNTYESEMTINMKFENARLKKAYVALQAWKKSIYSDPTNFTANWEGSNVCAYNGVFCDNALDDPNISVVAGIDLNHADIAGHLPVELGLLADVSLIHINSNRFCGIIPKSITNLTLLDEIDFSNNRFVGPFPDVVLDLPKLNYLDLRFNDFEGQVPSALFEKNLDAILINNNRFHSTIPESLGNSNASVVVLANNKFYGCIPSSIGKMGNSLDELVFTNNELSGCLPEEITKLTSLTLLDISGNKFVGSLPQDLKSMQKVEIFDIASNKFMGNVPKNLCTLPSLKNFTFSKNYFESMDETCRPSESKQVKIDGNENCLGGRSEQRTEKECFPVVSKPVDCSKGHCGVSREGQSPKDPPKTVTPPKPSTPTTPKPNPSPPPPKTLPPPPPKTSPPPPVHSPPPPPVASPPPPVHSPPPPVASPPPPVHSPPPPPVASPPPPVHSPPPPVASPPPPVHSPPPPVHSPPPPVASPPPPVHSPPPPVHSPPPPVHSPPPPVHSPPPPVHSPPPPVASPPPPVHSPPPPVHSPPPPVHSPPPPVASPPPPVHSPPPPPPVASPPPPVHSPPPPVASPPPPVHSPPPPVASPPPPVHSPPPPVHSPPPPVHSPPPPVASPPPALVFSPPPPVHSPPPPAPVMSPPPPTFEDVALPPTLGSLYASPPPPIFQGY

SEQ ID NO: 25209 - protein, 171 aa, Solanum chacoense
DSISGGGPDLIVDDGGDATLLIHEGVKAEEEFAKNGTIPDPTSTDNVEFQLVLTIIKESLKTDPLRYTKMKERLVGVSEETTTGVKRLYQMQANGTLLFPAINVNDSVTKSKFDNLYGCRHSLPDGLMRATDVMIAGKVALVAGYGDVGKGCAAAMKQAGARVIVTDIDPI

SEQ ID NO: 25210 - protein, 188 aa, Streptococcus mutans
MEEQNTEKKILLCLTGSGALLGITEYITFLTVRFKHVRVIVSDNAAKMLPVAAITQLCEKVYTDEVSFTDKQKNHIALTRWADITVVLPATANIIGKVANGIADNFMTTTLLSSSKPVLIYPCMNNIMWENPVVQKNVEVLSGTQYKVIVGQESESFELASGKMKKNIAIPSLDELQRVVLENLQEER

SEQ ID NO: 25211 - protein, 675 aa, Helicobacter pylori
MKKKANEEKAPKRAKQEAKTEATQENKAKESKIKEVKNKESKVKESKIKETKAKEPVPVKKLSFNEALEELFANSLSDCVSYESIIQISAKVPTLAQIKKIKELCQKYQKKLVSSSEYAKKLNAIDKIKKTEEKQKVLDEELEDGYDFLKEKDFLEWSRSDSPVRMYLREMGDIKLLSKDEEIELSKQIRLGEDIILDAICSVPYLIDFIYAYKDALINRERRVKELFRSFDDDDENSVSDSKKDDDSGEYEENEERKKVVSEKDKKRVEKVQESFKALDKAKKEWLKALEAPVDEKKDELVRLLTLAYKRQTLKDRLYDLEPTSKLINELVKTMETTLKSGDGFEKELKRLEYKLPLFNDTLIANHKKILANITNMTKEDIIAQVPEATMVSVYMDLKKLFLTKEASEEGFDLDPNKLKEILEQIKRGKLISDRAKNKMAKSNLRLVVSIAKRFTSRGLPFLDLIQEGNIGLMKAVDKFEHEKGFKFSTYATWWIKQAISRAIADQARTIRIPIHMIDTINRINKVMRKHIQENGKEPDLEVVAEEVGLSLDKVKNVIKVTKEPISLETPVGNDDDGKFGDFVEDKNIASSIDHIMREDLKAQIESVLDQLNEREKAVIRMRFGLLDDESDRTLEEIGKELNVTRERVRQIESSAIKKLRSPQYGRILRNYLRI

SEQ ID NO: 25212 - protein, 294 aa, Antirrhinum majus
MEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 25213 - protein, 280 aa, Antirrhinum majus
AYGVVYKARDIETNEDIALKKIRLEQEDEGVPSTAIREISLLKEMHHENIVNLKDVVHREKRLYLVFEYLDLDLKKHMDSCPEFSQDLHMVKMFLCQILRGVAYCHSHRVLHRDLKPQNLLIDRGSNTIKLADFGLARAFGIPVRTFTHEVVTLWYRAPEVLLGSRHYSTPVDVWSVGCIFAEMVNQKPLFPGDSEIDELHKIFRIIGTPNEDIWPGVTSLPDFKSSFPKWPPKELATIVPNLGATGLDLLCKMLQLDPSKRITAKKALEHEYFKDIVLP

SEQ ID NO: 25214 - protein, 312 aa, Antirrhinum majus
MAEEKSKSSAMDAFVKLEKVGEGTYGKVYRAMEKSTGKIVALKKTRLHEDEEGVPPTTLREVSLLRMLSRDPHVVRLLDVKQGQNKEGKTVLYLVFEYMDTDLKKYIRSFKQTGESIAPMNVKSLMYQLCKGVAFCHGHGVLHRDLKPHNLLMDRKTMMLKIADLGLARAYTLPIKKYTHEILTLWYRAPEVLLGATHYSPAVDMWSVACIFAELVTQKALFPGDSELQQLLHIFRLLGTPNEEIWPGVSTLVDWHEYPQWTAQPISSAVPGLDEKGLNLLSEMLHYEPSRRISAKKAMEHPYFDELDKSGL

SEQ ID NO: 25215 - protein, 417 aa, Pseudomonas stutzeri
SEFWVSLSLPKARDDAEDLPRAALLGRRVGLLEQHPLARQALQHQLEACGLAVLSFDSLDQLQDAVVAARASEQPIEIAVLGVTMREISPPQLCQRLWEFEALGCKCIVLCPTSEQAQYHDALPETHTHTQLQGKPACTRKLQQVLLELLRPPQALVEQVPVSDSRPPSVLCVDDNPANLMLLETLLTDMGGEVVAVSSGQQALEVVQQQSFDMVFMDVQMPGMDGRQTTEAIRRWELESGQPPLPIVALTAHALSNERRSLLQSGLDDYLTKPISERQLAQVVLKWTGLPLRRGAVAVPAESIAAESELKVLDAEEGLRLAAGKADLAADMLSMLLASLESDRQSIRDARAAEDQQALIDRVHRLHGATRYCGVPQLRAACERSETLLKQHHPSAGSALDELDSAIERLAREARIF

SEQ ID NO: 25216 - protein, 445 aa, Phaeosphaeria nodorum
MAPSAITTTEEYQTLKDSLQSLNSQTLGSVENHGAWKSKQLIGSALKSRVEAIDHDSCDVGDEDAFFIADLGEVYRQHLRWKKNLARVKPHYAVKCNPDTQVLRLMSELGMGFDCASKNEIETVLKLGVDPARIIYAQPCKTKSYVRYAANSGVKQMTFDNADELYKTKQLFPDAELYLRILTDDSGSLCRLSQKFGASLDTTAELLELAHKLELNVVGVAFHVGSGASDPKAFIKAVQDARFVFDQAAAFGFDMHTLDVGGGFTGDITFEPMAAVLSASLDEYFPPHIRVIGEPGRYYVSTAFTIACHVIARRTVADATLGTTSYMLYLNDGVYGNFSSIIFDHQHPVPRVLKSGNDVLYDVRTSGYDTPSQVEYSIWGPTCDGIDIISSSCSFPELLDVGDWLYFEDMGAYTKCSATKFNGFTDSHDVVYVCSEPGAKALMGM

SEQ ID NO: 25217 - protein, 298 aa, Cricetulus griseus
MENFQKVEKIGEGTYGVVYKAKNKLTGEVVALKKIRLDTETEGVPSTAIREISLLKELNHPNIVKLLDVIHTENKLYLVFEFLHQDLKKFMDASAVTGIPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 25218 - protein, 392 aa, Rana japonica
MATRRAAIAREVDNAVGAMRSKAQLNGRRAALGEIGNKVTVRAVKQPAKNSNTTSKTTRPVAKVSNVSVKPKAVTVTEAPSQVKEASPVPMDVSMKEEEELCQAFSEVLNHVVDIDAEDGGNPQLCSEYVVDIYNYLREREVQQSIKQRYLDGMEINERMRAILVDWLIQVNSRFQFLQETLYMGIAIMDRFLQVQPISRGKLQLVGVTSLLLASKYEEMYSPEVADFAYITDNAYTTSQIREMEMIILRELKFDLGRPLPLHFLRRASKACSADAEQHTLAKYLMELTLVDYEMVHFHPSEIAAAALCLAQKVLGVGSWGSTQHHYTGYTEEDLTPIIKHIAKNVTKVNQNRTKHVAVRNKYASSKLMKISTHPQLMSLVITELAASLTSQ

SEQ ID NO: 25219 - protein, 163 aa, Xenopus laevis
MSDEGKLFIGGLNFETNEDCLEQAFTKYGRISEVVVVKDRETKRSRGFGFVTFENVDDAKDAMMAMNGKSVDGRQIRVDQAGKSSGERRGGYRGGSSGGRGFFRGGRGRGGGDRGYGSSRFDNRSGGYGGSSGSRDYYGSGRSQGSYGDRSGGSYRDSYDSYG

SEQ ID NO: 25220 - protein, 553 aa, Pinus radiata
MENRRSSGGSGWWVCVLPLFTKDGPAYFLHSSSDDVSAWRQWPLYIALLIVAVCAVLVSWLSPGGCAWAGRHKRGRVAIPGPKGWPIIGSLMDMSVGLPHRKLESLARLHGAKQLMSFSLGCTPAVITSDPEVARELLTSPHFANRPLKQSAQQLLFGRAIGFAPNGGYWRLLRRIASAHLFAPRRIAAHEAGRQADVVAMLDDIQKEYHSKGVVRVRRHLQGAALNNIMGSVFGRRFDMSHENEEVKKLREMVDEGFQLLGAFNWADHLPWLRPLDPLRIHARCARLVPRVTTFVSNIIEQHRREEQRRESGDQCDFVDVLLSLQGEDKLDEEDMIAVLWEMIFRGTDTTALLTEWTMAELVLHPEAQKKAQAELDAVVGHDRSVKDSDIPKLPYIQAVVKEALRMHPPGPLLSWARLSTEDVNMGDGMCVPAGTTAMVNMWSITHDPNIWESPYEFRPERFVVFEGGEEVDVRGNDLRLAPFGAGRRVCPGKALGLATVNLWVAKLLHHFEWLPHAEHPVDLSEVLKLSCEMARPLHCVPVTRVPFAKFSD

SEQ ID NO: 25221 - protein, 378 aa, Schizosaccharomyces pombe
MDSIGDNVTEMDAFVRDLTMKPYAELEKRKAELHAQKLKLVQKRQQLLRDNYNVLVDYARNQDAFYQLLENSRHDFKELVLHTNQLYEPVKRSQNFLTSISEHYRDAKLMHQVQPQLSSILELPELMNACIERNYFSETLEFQALAYRLKDRFGTNSIIQELITQVETLVVKLTEKLILQLQKPLKLYSLIKVVTYLRVTAKLSEAQLKYVFLYFSWKQLQTSLRNLVPLLDYNNPELYLRRYIQVIRDRAFSLLFQYQSVFGESSNDRLNAAGTVDIPNSTSTSASPFEMDPEGFNNFGQNILSSFVRKLQLEICYVLQKFMPNVKDSTSKFSLLLQLYYCNQSLTKVGTDISIPLSKILGSEWLEMIHSQSSEKQA

SEQ ID NO: 25222 - protein, 230 aa, Arabidopsis thaliana
IFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATEYTFPQAEKVKEYLKDPSKFAVASVAAVSADAGGGAPAAAKVEEKEESDEEDYGGDFGLFDEE

SEQ ID NO: 25223 - protein, 144 aa, Sus scrofa
VVGIGGVMIGIFLGFIAAFTTRFTHNVRVIEPLFVFLYSYLSYITAEMFHLSGIMAITACAMTMNKYVEENVSQKSYTTIKYFMKMLSSVSETLIFIFMGVSTVGKNHEWHWAFVCFTLAFCLIWRALGVFVLTQVINWFRTIP

SEQ ID NO: 25224 - protein, 321 aa, Tulipa gesneriana
MAAFSYKQQQHQSNLLLDSTDHHHLSFQFQDLMTNSTSPFLYYPMPTSATNSTLDSASDNQKDCSSSVAEPQSSTEIRKRKDKSDGSCMTSVQSKGTKRETKSRKSQKKPKANESDEMKERTQEEEEAPVGYIHVRARRGQATDSHSLAERVRREKISERMKLLQALVPGCDKVTGKAVMLDEIINYVQSLQNQVEFLSMKLATVSPMLYEFGLDIEGQMNDLERVGSFPQDSQLLVPKTIPFQHRVCEEDTRSYSIGETSAPFLLHDQGPLSFSGVPFSVEMGTKHKAFSVNFCSTTSHLPTIENRRADKGRWGYGRKST

SEQ ID NO: 25225 - protein, 402 aa, Daucus carota
MVATTLESPRVETLAGSGIQLIPKEYVRPKDELISITNIFEEEKSDEGPQVPTVDIADILSEDKAVREKCYERIKDAAVEWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNTVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPEEQQKTEESNPQKIEILKPGEEASSSP

SEQ ID NO: 25226 - protein, 389 aa, Daucus carota
MVATTLESPRVETLAGSGIQLIPKEYVRPKDELISITNIFEEEKSDEGPQVPTVDIADILSDDKAVREKCYERIKDAAVDWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNMVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPTEQQKTEESNPQKI

SEQ ID NO: 25227 - protein, 254 aa, Schistosoma japonicum
MRDSFVLQQKDLSPSDLVQIAKLAEQAERYDDMAAAMKAYAELPAELGSEERNLFSVAYKNVVGARRSAWRVISAVEHKHDENSKKRQLTKEYRVKMEEELNEICREVLTLLSKYLTPKSNGFESQVFYRKMEGDYYRFLAEVATGDARKEVVEKSQAAYEKATEIAEEMLPSTHPIRLGLALNFSMFYYEIKCDPTQACNLAKRAFDTSIGELDSLQDDSYKDSTLIMQLLRDNLTLWASDQPEAEDVDGNDG

SEQ ID NO: 25228 - protein, 179 aa, Candida glabrata
MDKKGKYVVLVSGEGEKFTVEKKIAQRSLLLKNYLNDMHESSLDDEDEEQDEDEDEDDEIVMPVPNVRSSVLQKVIEWAEHHRDSNFPDEDDDDSRKSAPVDAWDREFLKVDQEMLYEIILAANYLNIKPLLDAGCKVVAEMIRGRSPEEIRRTFNIVNDFTPEEEAAIRRENEWAEDR

SEQ ID NO: 25229 - protein, 189 aa, Zymomonas mobilis
DPDAVKKMMDDIAAKYGKIDVLVNNAGILIPGKIMDASIEDWKKISSVNIDGVIYCAKFAMPYLVKSKGCIVNTASVSGLGGDWGMVYYCTTKGAVVNFTRALALDSGVNGVRVNSVCPCLVKTKMAANWPESAQAQFKNRVSLGRIPEAEEIASVMAFLASDDARFITGVNLPVDGGATASDGQPHLG

SEQ ID NO: 25230 - protein, 543 aa, Borrelia burgdorferi
MILDDGFQSDEEDIDIDVKLDDCDEEDISVKDDLGSGYIKGNVLKDSHSEDPIKLYLKEIGKEFLLTGNQEVELAKQMDSGESIIENILKNEGLVIENYYNLVNTIYSRMEREEFFKREKDKDKESSPDYYNKKKRIASFYKIPLKPIQDRLISYVDNKHRVYDLGGDIFEKNLKKERLALKELLRDIPLYQEELRIFSDDYIDSANKIKDLQRQQRIILSRLKIEKIRDLRVLGRDLTIAEKKIEIEKSLKLKEDAIKEQITEAQLAQKELERIEMYYEYPTDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLIQVLGKDPTDEELSDRLGWELKKVKTVKSVSREPVSLETPIGEEEDSVLSDFIEDKAIKNPANHTSFVVLQDQIRAILGTLPEREQEVVKMRFGLEDGYSLTLEEVGLHFNVTRERIRQIESKALRRLKNPKKTQKLKDYLEDLN

SEQ ID NO: 25231 - protein, 375 aa, Homo sapiens [sequence omitted]

SEQ ID NO: 25232 - protein, 391 aa, Homo sapiens [sequence omitted]

SEQ ID NO: 25233 - protein, 530 aa, Lycopersicon esculentum
MADVEGSPGSSMHGVTGREPVLAFSVASPMVPTDTSAKFSVPVDTEHKAKQFKFYSFSKPHGLTFQLSWISFFTCFVSTFAAAPLVPIIRDNLNLTKMDVGNAGVASVSGSILSRLTMGAVCDLLGPRYGCAFLIMLSAPTVFCMSFVSSAGGYVAVRFMIGFSLATFVSCQYWMSTMFNSKIIGLVNGTAAGWGNMGGGATQLIMPLLYDIIRRAGATPFTAWRIAFFIPGWLHVVMGILVLTLGQDLPDGNRGTLQKTGTVAKDKFGNILWYAATNYRTWIFVLLYGYSMGVELSTDNVIAEYFFDRFDLKLSTAGIIAATFGMANLLARPFGGFSSDYAAKKFGMRGRLWVLWILQTLGGVFCVLLGRSNSLPLAVTFMILFSIGAQAACGATFGIIPFISRRSLGIISGMTGAGGNFGSGLTQLLFFTSSKYSTATGLTYMGFMIIGCTLPVTFCHFPQWGSMFLPPTKDPVKGTEEHYYTSEYTEAERQKGMHQNSLKFAENCRSERGKRVGSAPTPPNLTPNRV

SEQ ID NO: 25234 - protein, 530 aa, Lycopersicon esculentum
MTDVEGSPGSSMHGVTGREPVLAFSVASPMVPTDTSAKFSVPVDTEHKAKQFKFYSFSKPHGLTFQLSWISFFTCFVSTFAAAPLVPIIRDNLNLTKMDVGNAGVASVSGSILSRLTMGAVCDLLGPRYGCAFLIMLSAPTVFCMSFVSSAGGYVAVRFMIGFSLATFVSCQYWMSTMFNSKIIGLVNGTAAGWGNMGGGATQLIMPLLYDIIRRAGAIPFTAWRIAFFIPGWLHVVMGILVLTLGQDLPDGNRGTLQKTGTVAKDKFGNILWYAATNYRTWIFVLLYGYSMGVELSTDNVIAEYFFDRFDLKLSTAGIIAATFGMANLLARPFGGFSSDYAAKKFGMRGRLWVLWILQTLGGVFCVLLGRSNSLPLAVTFMILFSIGAQAACGATFGIIPFISRRSLGIISGMTGAGGNFGSGLTQLLFFTSSKYSTATGLTYMGFMIIGCTLPVTFCHFPQWGSMFLPPTKDPVKGTEEHYYTSEYTEAERQKGMHQNSLKFAENCRSERGKRVGSAPTPPNLTPNRV

SEQ ID NO: 25235 - protein, 1419 aa, Plasmodium falciparum
MNGIFEGIEKRVVIKLKESFFKGNRNVNSFLDIPKELWEEKLKYIGCSIVSEISEDKNERRGERCRVYLLSESSLYIFDDSLFIKTCGKTRVLFFIPFVVDLLIYHMDNVGIIEKNCVYDETFIENEKFHNIAEFIKEHFLYCFFTHMNYRNKTKDGYFEQEYPHKSLEDEKKFFEFFFKNVQMYNTHLPMEKMHYIFFYSSDDVHMTDIASTFKFCSEIHLFGINKYNEKNQFHDAYLNNKSLNLFTRVHEDNLKLYDSSDADKEVTTHIYSTRGTYEDTGMVNCVDVIYKNESTLLNRNNIENIPSIENKESNNNSRCCHNNNYSGSCHNIVSVVPSERNNDHVHHRHYEDTLNRSNISAEDNNRNAQPEKEKDEDVRRDDEENKVLIKMIDTNLYECINYNKESFLYNEFYFTPCGYSCNVSEKNNYFCVHYSPEDSVSYVSVEVSSNLSCDRFLDFIHKQLNFYNGKYMFMINYVFCEESNNMSKMVPDDDNNNYSSGKSCVYYQDLNKKEKEEYYRLNKKLRNDLFINSKQFYELHTFTERTVGFMRVQYFVYKLRDVVKCVEKETLLARSSSCLFMFNNIKRNDVHDDYVTKSSNGGVIKQLTERDVDDMYEYALNFCKQNKIVVVDTNTFFFDASKRKENLIKLEKVQTNEKDEYEEKDEVYRRGNNELSSLDHLDSKNNLIHMYYEKNKCDIINKDDENSTIATNNNDNNNDSSSYDKSITISRSSSCNNSHLSYSSFDNNHGNEKMKDYISVDENNNNNNNNKNNNVLLTLQRNSDDENGKDKDNEKNDVSLENNMEKNYKEEIWNYYTKNKVEVKTLEKVLNENIDTSVVCINLQKILAQYVRFKKNLPHVTPFYSVKSNNDEVVIKFLYGLNCNFDCASIGEISKVIKLLPNLSRDRIIFANTIKSINSLIYARKENINLCTFDNLDELKKIYKYHPKCSLILRINVDFKNYKSYMSSKYGANEYEWEEMLLYAKKHNLNIVGVSFHVGSNTKNLFDFCLAIKLCRDVFDMSSNMGFNFYIINLGGGYPEELEYDNAKKHDKIHYCTLSLQEIKKDIQKFLNEETFLKTKYGYYSFEKISLAINMSIDHYFSHMKDNLRVICEPGRYMVAASSTLAVKIIGKRRPTFQGIMLKELKDHYDPLNFAQQENKKQDETKINHNNDNNDNNDNNDNNINNNNNNQKGGQGNIMNDLIITSTNDSTSKKNDHSSSQVIQNVSCTIRDKEGDNIKINTHTINNPNINGKENTVDGDNINIAHKNIGNNFSSSNSKLGNITNIKKKVVNINDNRYNYFSYYVSDSIYGCFSGIIFDEYNRCPIYVIKNKNNPNQNFMNFNLYLANVFGQSCDGLDMINSITYLPECYINDWLLYEYAGAYTFVSSSNFNGFKKCKKVYIFPESKPSLKGQPNKHW

SEQ ID NO: 25236 - protein, 264 aa, Oryza sativa
MVQGASGGGWSSKVEEGVIVGGLLVVQCILAGYVVFVDHVLSLGANPLSLIVLGAVASSLFFLPFAVVLERYSGHHYLFMLLGIKKTTPAIASAMPNLSPGLIFIIAACFRYSSSCLMAMSFLQSPVSSSPQLTTTSYYDWILGCFYLFLAVVVLSIYTVLQVIINYYMCSVTSMMGAVFTAILQFIVDGKIDMGSPRIDETIISTIVLMVHTFSSIFCCSIYISRSNMVLMFCGLYIVLWAKSKEGHSIIHLEGGDVEKALLS

SEQ ID NO: 25237 - protein, 381 aa, Jonopsidium acaule
AMVQHQPPPQVPPPPSQQSPVTPLTAAFGMRLGGLEGLFGPYGIRFYTAAKIAELGFTASTLVGMKDEELEDMMNSLSHIFRWELLVGERYGIKAAVRAERRRLQEEEEDESSRRRHLLLSAAGDSGTHHALDALSQEDDWTGLSEEPMHQDQTDAAGNGGFGGYLESSVHGKMKKHQPRRRKKPLVLTSVETDDDGNDNEDDDGMDNGNGGIGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAA

SEQ ID NO: 25238 - protein, 387 aa, Jonopsidium acaule
QHQPPPQVPPPPSQQSPVTPQTAAFGMRLGGLEGLFGPYGIRFYTAAKIAELGFTASTLVGMKDEELEDMMNSLSHIFRWELLVGERYGIKAAVRAERRRLQEEEEDDSSRRRHLLLSAAGDSGTHHALDALSQEDDWTGLSEEPVHQDQTDAAGNGGFGGYLESSVRGKMKKHQPRRRKKPLVLTSVETDDDGNDNEDDDGMDNGNGGIGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISC

SEQ ID NO: 25239 - protein, 409 aa, Ancylostoma caninum
FEWLATTSGAREDELSLDSCHSAFSPVPRNTFSMASTSVPENYYVVPIGETQMVILKRYENLRLIGSGAQGIVCAATDMVTNKPVAIKKLSRPFQNVTHAKRAYREFILMNLVNHKNIIGLLNAFSPQREVEEFNDLYIVMELMDANLCQVIQMDLDHERLSYLLYQMLCGIKHLHSAGIIHRDLKPSNIVVKSDCTLKILDFGLARTAVEAFMMTPYVVTRYYRAPEVILGMGYGENVDVWSVGCIFGELIRGRVLFPGADHIDQWTRIIELLGTPEPQFLARLQTTVRNYVENRQKYQPVPFETLFADNMFPPGADNARLTAAKARDLLSRMLVIDPEKRISVDDALAHEYVNVWYDASRGSCSSAGPSTILLVDGEHTVEEWRAMLFAELQNYYRTHDVYGVGQRR

SEQ ID NO: 25240 - protein, 299 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSHSGNGCKNEKLFNGEFTKTE

SEQ ID NO: 25241 - protein, 465 aa, Homo sapiens
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPISEKAKDLILRFCCEWEHRIGAPGVEEIKSNSFFEGVDWEHIRERPAAISIEIKSIDDTSNFDEFPESDILKPTVATSNHPETDYKNKDWVFINYTYKRFEGLTARGAIPSYMKAAK

SEQ ID NO: 25242 - protein, 381 aa, Homo sapiens
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 25243 - protein, 249 aa, Oryza sativa (japonica cultivar-group); identical to SEQ ID NO: 3252

SEQ ID NO: 25244 - protein, 124 aa, Giardia intestinalis
MSTKPVKDNSKMKSRSARAGISFPIGRIHRHLREGRYAERISSDAPVYLAAVLENVVAEVFREACNHRDKKSQKRIVPNHILTALRKDKELATIFANVTIREGGVARSAKEGREGKGSHRSQDL

SEQ ID NO: 25245 - protein, 99 aa, Giardia intestinalis
MSGKGKGKGYGKSKRHSKEKDTLGGITKPAIRRLARRGGVKRISSTIYQQTREVLKAFLEVVLRDSLTYTEHGQRKTVTSQDVVYALKRQGRTLYGFGI

SEQ ID NO: 25246 - protein, 721 aa, Pyrobaculum aerophilum
MNMISYALLGVILGISGVIYAVYLAVWVLRQDPGNEKMRFISQAIATGARAYLFRQYRTLAVLLVILAVLILVAIDMPRRTFGLTALAFIVGALGSMLAGYLGMYVTTRSASRVAQAAATGGMGKALLVSWRAGAVMGLSLASIALLLISGFYLVFRSVLPDDWAVPLVALGFGASLVTLFMRVGGGIYTKAADLGADLVGKVEAGIPEDDPRNPGVIADNVGDNVGDVAGMAADVYESYIVTVTAAIFLAAILGLPTQFIEAIILFAALALVATFAGVNLLKTTGVKHPLSSISLAIYATIGLTVVLFFIGAFTLGLDSTKALALAATTSLGAVIAPLIVKITDYYTSYNYGPVRKIAEQAKISPATVIITGYGVGLMSAIPVIAVIVAVLGISYMIGYYTVPVSGFGELSKYLAGIFGTAMASVGLLVVAGIIITADSYGPVSDNAGGVVEMAGLPDEVREITDVLDSVGNTTKATTKGYAIASAALAALVLFIALIFEIVYSASKILGKGIVDMISESLSGLQLINANVLIGAFLGVALVYFFSSRTLEPVGRTAMEIVEEIRRQFREKPGILEWKEQPDYARVVDIATRRALGEFLIPGLAAIVLPLITGLLLGWNALAGLIMGAIVAGVPRALLMANAGGAWDNAKKYIEIQGLKKTEMHKAAVIGDTVGDPMKDTVGPSLNPLIKVLNTLSVVFTYVIVSTNIALGIWPSGLLPF

SEQ ID NO: 25247 - protein, 382 aa, Arabidopsis thaliana
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 25248 - protein, 131 aa, Solanum melongena
DPKKKPVTRSVKAGLQFPVGRIGRYLKKGQYAQRVGSGAPVYLAAVLEYLAAEVLELAGNAARDNKKNRIIPRHLLLAVRNDEELGKLLAGVTIAHGGVLPNINPVLLPKKTGAEKAPKSPSKATKSPKKA

SEQ ID NO: 25249 - protein, 125 aa, Entodinium caudatum
GKGKAGRGKTGGKTQSRSAKAGLQFPVGRIARYLKTGKYAERVGAGAPVYLAAVLEYLAAEVLELAGNAAKENKKTRIIPRHIQLAVRNDEELNKLMANTTIASGGVMPSIHPSLIPHKGKEKEE

SEQ ID NO: 25250 - protein, 95 aa, Actinidia deliciosa
TNQVFRYAKKAGASYINKPKMRHYVHCYALHCLDEEASNALRRAFKERGENVGAWRQACYKPLVAIAARQGWDIDSIFNAHPRLAVWYVPTSLRH

SEQ ID NO: 25251 - protein, 126 aa, Actinidia deliciosa
  unsure (1)..(126): unsure at all Xaa locations
IENKINRQVTFSKRRSGLLKKANXISVLCDAEVALIVFSHRGKLFEYSTDACMEKILERYERYSYAERELVNDPETPFLNVQKNWSLECTRLGEKIELLQRNIGHYMGQHLDSLSLKDLQHFEQQL

SEQ ID NO: 25252 - protein, 254 aa, Salmonella typhimurium LT2
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTRWAVIPKKRCWTSWPMKKRTVRKTPRKMTI

SEQ ID NO: 25253 - protein, 228 aa, Salmonella typhimurium LT2
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPAGR

SEQ ID NO: 25254 - protein, 326 aa, Salmonella typhimurium LT2
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 25255 - protein, 330 aa, Salmonella typhimurium LT2
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVQKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 25256 - protein, 330 aa, Salmonella typhimurium LT2
MSQNTLKVHDLNEDAEFDENGVEAFDEKALSEDEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 25257 - protein, 242 aa, Salmonella typhimurium LT2
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEK

SEQ ID NO: 25258 - protein, 330 aa, Salmonella typhimurium LT2
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTCERVRQIQVEGLRRLREILQTQGLNIEALFRE

SEQ ID NO: 25259 - protein, 115 aa, Arabidopsis thaliana
MVKSTSKDAQDLFRSLRSAYSATPTNLKIIDLYVVFAVFTALIQVVYMALVGSFPFNSFLSGVLSCIGTAVLAVCLRIQVNKENKEFKDLAPERAFADFVLYNLVLHLVIINFLG

SEQ ID NO: 25260 - protein, 123 aa, Gallus gallus
MSGTAGSGVGAAGSVGSVVRRFLAEYGSGTSSRLKVLDAYLLYVMLTGALQFGYCLGVGTFPFNSFLSGFISAVGSFILGVCLRIQINPQNKGEFQGISPERAFADFLFANTILHLVVINFVG

SEQ ID NO: 25261 - protein, 119 aa, Malus x domestica
MGKASHSSTAQDAVALFDSLRSAYSATPTTLKIIDLYIGFAVSTALIQVVYMAIVGSFPFNSFLSGVLSCIGTAVLAVCLRIQVNKENKEFKDLAPERAFADFVLCNLVLHMVIMNFLG

SEQ ID NO: 25262 - protein, 114 aa, Oryza sativa; identical to SEQ ID NO: 3988

SEQ ID NO: 25263 - protein, 115 aa, Picea mariana
MGTSTAKEAHALIASLRSAYSATPTKLKIIDLYVVYAILTAVVQVVYMAIVGSFPFNAFLSGVLSCTGTAVLAVCLRMQVNKENREFKDLPPERAFADFVLCNLVLHLVIMNFLG

SEQ ID NO: 25264 - protein, 207 aa, Campylobacter fetus
MVIVKKISAIEVLDSRGNPTIKTKVELCDGSIGEAIVPSGASTGKRERLELRDGGEAFGGKGVLKAIKNVNSMIAEEICGKDAYNQKAIDDAMLALDGTDNYSRIGANAVLGVSMAVARAAANSLNIPLYRYLGGANACTLPVPMFNIINGGAHANNSVDFQEFMIMPFGFSKFSNALRAATEVYQTLKKILNDLGHSTAVGDEGGF

SEQ ID NO: 25265 - protein, 440 aa, Cladosporium herbarum
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 25266 - protein, 434 aa, Staphylococcus aureus
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSQRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 25267 - protein, 422 aa, Streptococcus thermophilus
MTVTIENIHAREIFDSRGNPTVEVDVRLTDGTLGRAAVPSGASTGDREAVELRDGGARLQGKGVSKAVANVNGEIYEALKGQSPFNQAKLDHLMIELDGTENKSCLGANAILGVSMAIFRAAANSEKIPLYRYFGGVDLELPQPFFNVINGGVHADSGIDVQEFLITPVKRDSFRDGLKKIANIYHTLKKILSDKGLKTPVGDEGGFAPKLGTTENAIAILYQPIDSAGYFPGEKIAIAIDSSSIEFYDDKKKFYRFEGKNLTSKELLTYYDNLVEKYPALISIEDGFSEHDWEGFAAQTKARGQKIQLVGDDIFVTNPTIFKEGIKKNVANAILIKLNQIGTVTETIETISLARKAGYKTMISHRSGETVDSYIADFSVAMHAGQIKSGSMARSERVEKYNQLLRIEEDLGKDVALAQFPG

SEQ ID NO: 25268 - protein, 329 aa, Schizosaccharomyces pombe
MDVVLQYADKYVFDTFYGKIAESFDSSSSFANTAVNSTTLGLAEKVNFAITSGLLDRNNVWRQFTSLFLITWIMGTLSYFLSASFAYYVYFDREEARRHPKFLKNQEHLELMVALKNLPGMAILTAPWFLAEIRGYGYVYDKLDEYGYFYLFFSIALFLLFSDFLIYWIHRALHHRWLYAPLHKLHHKWIVPTPYSSHAFHYLDGYSQSLPYHMFPFFFPLNKYVYLLLFGSVNYWTVLIHDGKYFSNNAVVNGAAHHAAHHMYFNYNYGQFFTLFDRLCSSYRQPDQELFDAELRNEKLQEQRIRFMETVQYTVEGKDDRTYASKKDN

SEQ ID NO: 25269 - protein, 291 aa, Matthiola incana
QVPVVDLSCPDEELVARTVVKASEDWGVFQVVNHGIPTELIQRLQKVGREFFELPEAEKRSCAREAGSVEGYGRRIELDIKKRKGIVDQIYLSTWPPSSVNYRYWPKSPPDYREVNEEYARHVKTLSEKIMEWLSEGLGLGREAIKEVNGCWYVMNINHYPPYPHSDSFNGLEPHTDINGLTLIITNEIPGLQVFKDDHWIEVEYIPSAIIVNIGDQIMMLSNGKYKNVLHKTTVDKEKTRMSWPVLVSPTYDMVVGPLPELTSEDDPPKFKPIAYKDYVHNKITFLKNKS

SEQ ID NO: 25270 - protein, 354 aa, Xenopus laevis
MAGCCLSAEEKESQRINAEIEKQLRRDKRDARRELKLLLLGTGESGKSTFIKQMRIIHGSGYTDEDRKGFTKLVYQNIFTSMQSMIRAMDTLRIQYTSEQNMENALVIREVEVDKVSSLERKHVEAIKKLWEDEGIQECYDRRREYQLSDSTKYYLSDIDRISNPGFIPTQQDVLRVRVPTTGIIEYPFDLENIIFRMVDVGGQRSERRKWIHCFENVTSIIFLVALSEYDQVLAECDNENRMEESKALFKTIITYPWFQNSSVILFLNKKDLLQEKIMYSHLIDYFPEFTGPKQDSQAARDFILKLYQDQNPDKEKVIYSHFTCATDTENIRFVFAAVKDTILQLNLREFNLV

SEQ ID NO: 25271 - protein, 353 aa, Cochliobolus heterostrophus
MGCGMSTEEKEGKQRNEEIENQLKRDKLMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGPDYAAACDYILNRFVSLNQHETKQIYTHFTCATDTMQIRFVMAAVNDIIIQENLRLCGLI

SEQ ID NO: 25272 - protein, 553 aa, Candida albicans
MGIASILSNKNITINVDHVIDSDEAMLLAIGYRQELRREFSLWSIFAVSFSVLGLLPSIAACFDYQQLVVGMSPLPWLIAMIFITSVAYSMAEIASAFPCSAGTPYAVSQLAPKKYASFLTWFTCWTNWSCQITAAPSVSYSCACMMLALHSFTDPSFVASNAQIFGLTTGIQVLCAFMACFPTKWVARFSSAGTTCNIVFLVVVFIMILGGNKRDQIKEGISKFNSNSTAWGLDNQAEWPTGLSFLISFMGVIWAMSGYDSPFHLAEKCSNAAVAAPRAIVLTSTVGGLIGFMFMIAIAYTLVDLNQISADPESLGQPFVTYLTQIMDKNLVIGATALTIISSFFMAQNCLLASSRVTYAYARDGLFPLSGIWKKVSPKTQTPINAVIMNFIVEELLLLLIFGGDVSIGSIFSIGALAGFISFTMPTLLKITYARKTFQPGPWNLGKWSEPIGWVSVAFVGLMVPILCFPTVKGADLTPTEMNWTCLVYFGLILLTTIWFVVYARRWYVGPRTNISEEDIVYGEKTEDEGDEIPDVIDGQKVSISSTEKRYQ

SEQ ID NO: 25273 - protein, 545 aa, Candida albicans
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 25274 - protein, 209 aa, Macaca mulatta
MGNAAAKKDTEQETVNEFLAKARGDFLYRWGNPAQNTASSDQFERLKTLGTGSYGRVMLVRHRETGNHYAMKILDKQKVVRLKQVEHTLNEKRILQAINFPFLVKLQFSFKDNSNLYLVMEYVPGGEMFSHLRRVGRFSEPQACFYAAQVVLAFQYLHSLDLIHRDLKPENLLIDQQGYLQVTDFGFAKRVKGRTWTLCGTPEYLAPEI

SEQ ID NO: 25275 - protein, 294 aa, Candida albicans
MPSDPEEDYIPWIQQLCELFGHDYFVQVSQDFIEDDFNLTGLSSQVPYYREALYTILDYQVETAEDHNTDNTTTNTSNNNDSRNGTSKRNASELPNKALLAHSAELLYGLIHARYIVSKQGLTAMASKFERNDFGSCPRYFCDGMHLIPVGSTDVPGQETVRLFCPCCNDIYIPSSSRYLNIDGAFFGTTFPGLLVKMFPEIENQCRIRITKFSQNDFGLKLFGFKINELSATGPRMKWLRMHPETEGEKQELTHVNIMFQLATYMKTKRMEEDDEEEEDEVEEEDDDRTMASE

SEQ ID NO: 25276 - protein, 221 aa, Spodoptera frugiperda
MSSSEEVSWISWFCGLRGNEFFCEVDEDYINDKFNLTGLNEQVPHYRQALDMILDLEPDDDLDDNPNQSDLVEQASEILYGLIHARYILTNRGIGQMLEKFQAGDFGHCPRVYCECQPMLPLGLSDVPGEAMVKLYCPRCMDVYTPKSSRHHHTDGAYFGTGFPHMVFMVHPEYRPKRPASQFVPRLYGFKIHPLAYQIQQQAAANFKAPLRSLSYNNGKR

SEQ ID NO: 25277 - protein, 219 aa, Drosophila melanogaster
MTDSDESSWIHWFCKQRGNEFFCEVDEEYIQDKFNLNFLDSNVKNYKCALEVILDLNPGSASEDPAEPELEASAEKLYGLIHARFILTNRGIELMLDKYNKGEFGTCPRAFCHSQPVLPIGLSDNPGEDMVRIYCPKCNDVYIPKASRHSNLDGAFFGTGFPHMFFMEKPDARPKRAKQKFVPRLYGFKIHPTAYRTAAEIQKDVTMTPVGEIDSPSHI

SEQ ID NO: 25278 - protein, 658 aa, Lytechinus pictus
MSNSTLEMKGFARRGALRQKNVHEIKNHKFIPRFFKQPTFCSHCKDFIWGFGKQGFQCKVCSFVVHKRCHEFVTFQCPGLDPGVDSDDPRNKHKFKVHSYNSPTFCDHCGSLLYGLYHQGMKCGACDMNVHKRCQKSVPNLCGADHTERRGRIKVKAEVIGNKLQVTVAEAKNLIPMDPNGLSDPFVKLKLIPDQKRETKKKTRTIKGSLNPTWGESFDFNLEDTDRNRRLLVEVWDWDRATRNDFMGALSFGISELMKAGVDAWYKLLGQEEGEYYNVPAIAETESIDELTSNIKKLPMPTQEHVKPQNSNSMSGMGVVRASDFNFLSVLGKGSFGKVMLAEKKGTDELYAIKILKKDVIIQDDDVECTMTEKRVLGLPSKPAFLTALHSCFQTMDRLFFVMEFVNGGDLMFQIQKVGKFREPHAVFYAAEIAVGLFYLHSQGVIYRDLKLDNVLVDAEGHIKIADFGMCKEHMNEGDTTRTFCGTPDYIAPEIVAYQPYGKAVDWWAFGVLLYEMLAGQPPFDGEDEDELFQSIMEHVPSYPKSMSRESVTMCKGFLTKHPGKRLGSGPTGEQDIREHQFFRRIDWEKLANREIQPPFVPSVRNPRAAENFDPYFTKIPCALTPTDKLIIMNIQDEFQGFTFVNEVFDGYVRSLPS

SEQ ID NO: 25279 - protein, 523 aa, Rattus norvegicus
MKKFKRRLSLTLRGSQTIDESLSELAEQMTIEESSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQISSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLDKDLKQYMDDCGSIMSMHNVKLFLYQILRGLAYCHRRKVLHRDLKPQNLLINERGELKLADFGLARAKSVPTKTYSNEVVTLWYRPPDVLLGSSEYSTQIDMWGVGCIFFEMASGRPLFPGSTVEDELHLIFRLLGTPSQETWPGVSSNDEFKNYNFPKYKPQPLINHAPRLDSEGIELITKFLQYESKKRAPAEEAMKHVYFRSLGPRIHALPESVSIFSLKEIQLQKDPGFRNSSYPETGVFVINHFTCRS

SEQ ID NO: 25280 - protein, 451 aa, Rattus norvegicus
MNKMKNFKRRLSLSVPRPETIEESLTEFTEQFNQLHTQRNEDGRDEPGQLSPGVQYQQRQNQRRFSMEDLNKRLSLPMDIRLPQEFLQKLQLENPGLPKPLTRMSRRASLSDIGFGKLETYVKLDKLGEGTYATVFKGRSKLTENLVALKEIRLEHEEGAPCTAIREVSLLKDLKHANIVTLHDLIHTDRSLTLVFEYLDSDLKQYLDHCGNLMNMHNVKIFMFQLLRGLAYCHRRKILHRDLKPQNLLINERGELKLADFGLARAKSVPTKTYSNEVVTLWYRPPDVLLGSTEYSTPIDMWGVGCILYEMATGKPLFPGSTVKEELHLIFRLLGTPTEESWPGVTSISEFRAYNFPRYLPQPLLSHAPRLDTEGINLLTSLLLYESKSRMSAEAALSHPYFQSLGERVHQLDDTASIFSLKEIQLQKDPGYRGLAFQHPGRGKSRRQSIF

SEQ ID NO: 25281 - protein, 217 aa, Linum usitatissimum
RIRARYPIIAAHLAPGSESRFDFQKYVNRSLEDDFKVVVGISPILWFFAVLFLLSNTHGWVAYLWLPFIPLIIILVVGTKLQVIITQLGLSIQDRGDVVKGAPVVQPGDDLFWFGRPRLVLFLIHFCLFQNAFQLAFFIWSVYEFGIKTCFHEKTEDIVRASGLVPNRDTSATQTTELSKGKLMMADTCLPTEDLVGMVVTAAHSGKRFFVDSIRYD

SEQ ID NO: 25282 - protein, 211 aa, Gossypium raimondii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 25283 - protein, 212 aa, Gossypium turneri
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEM

SEQ ID NO: 25284 - protein, 206 aa, Gossypium harknessii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQ

SEQ ID NO: 25285 - protein, 211 aa, Gossypium thurberi
DVYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 25286 - protein, 219 aa, Gossypium thurberi
DVYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 25287 - protein, 210 aa, Gossypium trilobum
VYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 25288 - protein, 215 aa, Gossypium trilobum
VYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 25289 - protein, 208 aa, Gossypium klotzschianum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVI

SEQ ID NO: 25290 - protein, 215 aa, Gossypium klotzschianum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGG

SEQ ID NO: 25291 - protein, 209 aa, Gossypium davidsonii
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIV

SEQ ID NO: 25292 - protein, 215 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGG

SEQ ID NO: 25293 - protein, 214 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTG

SEQ ID NO: 25294 - protein, 219 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHAGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 25295 - protein, 219 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 25296 - protein, 216 aa, Gossypium schwendimanii
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 25297 - protein, 216 aa, Gossypium schwendimanii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 25298 - protein, 220 aa, Gossypium schwendimanii
DIYYWECKGYTPLFPRILGHEASGIVESVGEGVNDLKPGDHVLPIFTGECKGCRHCLSEESNNMCELLRTNCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 25299 - protein, 220 aa, Gossypium schwendimanii
DVYYWECKGYTPLFPRILGHEASGIVESVGEGVNDLKPGDHVLPIFTGECKECRHCLSEESNNMCELLRTNCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 25300 - protein, 215 aa, Gossypium lobatum
IYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 25301 - protein, 281 aa, Streptomyces nogalater
MRAMTDSTGPRPVPAMSPAPSPTPSPGPAPGSEPAPLAVIVTGGGSGIGRATARAFAAQGAKVLVVGRTEDALAQTAEGCADMRVLVADVASPDGPQAVVNAALREFGRIDVLVNNAAVAGMETLQTVDRDAVARQFGTNLTAPLFLVQSALGALEKSRGIVVNVGTAATLGLRAAPTGALYGASKVALDYLTRTWAVELAPRGIRVVGVAPGVIDTGIGVRMGMTPEGYREFLTGMGGRVPVGRVGRPEDVAWWIVQLARPEAGYATGMVVPVDGGLSLV

SEQ ID NO: 25302 - protein, 190 aa, Arabidopsis thaliana
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLEAEEMGAKYRATGVVPKATCGCF

SEQ ID NO: 25303 - protein, 158 aa, Lycopersicon esculentum
MQEQATSSIAASSLPSSSERSSSSALHHELKEGMESDDEIRRVPEMGGEATGTTSASGRDGVSAAGQAQPSAGTQRKRGRSPADKENKRLKRLLRNRVSAQQARERKKAYLIDLEARVKELETKNAELEERLSTLQNENQMLRHILKNTTAGAQEGRK

SEQ ID NO: 25304 - protein, 589 aa, Brassica napus
MSLPETKTQTLLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCDPTTSSHCVQANGIQLTVLYLALYLTALGTGGVKASVSGFGSDQFDDTEPKERSQMTYFFNRFFFCINVGSLMAVTVLVYIQDDVGRKWGYGICALAIVLSLSIFLAGTNRYRFKKLIGSPMTQVGTVLVAAWRNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 25305 - protein, 561 aa, Arabidopsis thaliana
MSDLQTPLVRPKRKKTWVDYFVKFRWIIVIFIVLPFSATFYFLIYLGDMWSESKSFEKRQKEHDENVKKVIKRLKGRDASKDGLVCTARKPWIAVGMRNVDYKRARHFEVDLGEFRNILEINKEKMTARVEPLVNMGQISRATVPMNLSLAVVAELDDLTVGGLINGYGIEGSSHIYGLFADTVEAYEIVLAGGELVRATRDNEYSDLYYAIPWSQGTLGLLVAAEIRLIKVKEYMRLTYIPVKGDLQALAQGYIDSFAPKDGDKSKIPDFVEGMVYNPTEGVMMVGTYASKEEAKKKGNKINNVGWWFKPWFYQHAQTALKKGQFVEYIPTREYYHRHTRCLYWEGKLILPFGDQFWFRYLLGWLMPPKVSLLKATQGEAIRNYYHDMHVIQDMLVPLYKVGDALEWVHREMEVYPIWLCPHKLFKQPIKGQIYPEPGFEYENRQGDTGDAQMYTDVGVYYAPGCVLRGEEFDGLEAVRRMEKWLIENHGFQPQYAVSELDEKSLWRMFNGELYEECRKKYRAIGTFMSVYYKSKKGRKTEKEVREAEQAHLETPYPEAD

SEQ ID NO: 25306 - protein, 248 aa, Silene latifolia
MEFSSQITREEGSPSSQRKLGRGKIEIKRIENTTNRQVTFCKRRNGLLKKAYELSVLCDAEVALIVFSSRGRLYEYANHSVKGTIDRYKKASSDNSGASSAAEANAQYYQQEAAKLRNQIRTVTENNRHLMGEGLSSLNMKDLKSLENKLERGISRIRSKKNELLFAEIEFMQKREVELHNNNQYLRAKIAENERAQQSMSLMPGGSSEYELAPPPQSFDSRNYFQVNALQPNNTHYSRPDQTTLQLN

SEQ ID NO: 25307 - protein, 213 aa, Silene latifolia
MGRGKIEIKRIENSTNRQVTYSKRRNGIIKKAGEITVLCEAKVSLIIFSNNGKMHAYHSPETAVEDILDQYHKISGKRLWDAKHENLSNEIDRVKKENDNMQIELRHLKGEDITSLPYPDLMRLEDALENGLVGVREKQMEMYKLHKKNHKMLEDENNQLAYMLHKQEMDGNMREMEAGVCSNPSDRDYHYQNPIPPYGFRVQPMQPNLQDRM

SEQ ID NO: 25308 - protein, 227 aa, Silene latifolia
MARRKIQIKKIENLTNRQVTYSKRRNGLFKKANELTVLCDATVSIIMLSSNLKLHEFLSPGSNLTTKDVYDRYQKALGVDIWVTHEKRMQDDLQKLNELNRKLQTDIRQRMGDCLEDLSFEELCRLGQEMQEAVTLIRERKYKKIDNQIDTTKKKVRNGQEVHKGLLQEFEIPKDEPPYGLVDNGDYSNVMGYNDASRVLALRLQPCQPNLHAGAGSGSCVTTYALL

SEQ ID NO: 25309 - protein, 246 aa, Silene latifolia
MGRGRVQLKMIENKINRQVTFSKRRSGIIKKAHEISVLCDAEVALIIFSHRGKLFDFASDSCMEKILERYERYCYAEKQLASNDPDAQVNWTFDYAKLKAKLDLLQRNHRQYLGQDLDALNLKELQSLEQQLDVGLKHIRSKKNQLMHDSISELQKKERSMEEQNKMLTKKIKEKGKAATTETQQMQWQQQQQNHQDVATSSDYLIHPPVPLNMSNSYEKEQGGEGSRNDLNLTLESNCWAHHSLF

SEQ ID NO: 25310 - protein, 257 aa, Silene latifolia
MGRGRVQLKRIENKINRQVTFSKRRTGLLKKAHEISVLCDADVGLIVFSTKGKLFEYATDSCMEKILERYERYSYAERQLTAPDPDSHVSWTLEHAKLKARLEILQKNHRHYMGEDLDTLSLKELQNFEHQLDTALKHIRSKKNQLMYESIHELQKKDKALQEHNNTLSKKVKEKEKEKEKEKAIADQQAQWVQQNQELNPSAFFSSQVLPALNIRGNYETGSSVIVNEVAQTQNRSNSSNNNSLVPSWMLNHLAEQ

SEQ ID NO: 25311 - protein, 525 aa, Xenopus laevis
MAVTCTRFTDEYQLYEEIGKGAFSVVRRCVKLCSGHEYAAKIINTKKLSARDHQKLEREARICRLLKHPNIVRLHDSISEEGFHYLIFDLVTGGELFEDIVAREYYSEADASHCIQQILEAVLHCHQMGVVHRDLKPENLLLASKCKGAAVKLADFGLAIEVQGEQQAWFGFAGTPGYLSPEVLRKEAYGKPVDIWACGVILYILLVGYPPFWDEDQHKLYQQIKAGAYDFPSPEWDTVTPEAKNLINQMLTINPTKRITAHEALKHPWVCQRSTVASMMHRQETVECLKKFNARRKLKGAILTTMLATRNFSVGRQTTAPATITTAATSTALGLVEQAKSLLNKKTDVGKPQTNSTKNSAGVTSPKGPIPPAALESSDSTHTNPEDEEMKARKQEIIKITEQLIEAVNNGDFEAYAKICDPGLTTFEPEALGNLVEGIDFHRFYFENLLSKNNKPIHTTILNPHVHVVGEDAACIAYIRLTQYIDTQGRPRTSQSEETRVWHRRDGKWQNVHFHCSGAPVAPLQ

SEQ ID NO: 25312 - protein, 483 aa, Arabidopsis thaliana
MRRNVDNQSYYVLGHKTPNIRDLYTLSRKLGQGQFGTTYLCTDIATGVDYACKSISKRKLISKEDVEDVRREIQIMHHLAGHKNIVTIKGAYEDPLYVHIVIELCAGGELFDRIIHRGHYSERKAAELTKIIVGVVEPCHSLGVMHRDLKPENFLLVNKDDDFSLKAIDFGLSVFFKPGQIFKDVVGSPYYVAPEVLLKHYGPEADVWTAGVILYILLSGVPPFWAETQQGIFDAVLKGYIDFDTDPWPVISDSAKDLIRKMLCSSPSERLTAHEVLRHPWICENGVAPARALDPAVLSRLKQFSAMNKLKKMALKVIAESLSEEEIAGLRAMFEAMDTDNSGAITFDELKAGLRKYGSTLESTEIHDLMDAADVDNSGTIDYSEFIAATIHLNKLEREEHLVSAFQYFDKDGSGYITIDELQQSCIEHGMTDVFLEDIIKEVDQDNDGRIDYEEFVAMMQKGNAGVGRRTMKNSLNISMRDV

SEQ ID NO: 25313 - protein, 625 aa, Pseudomonas syringae
MQSKTSRRTFVKGLTAMGVLGGLGLWRNPSWALSGPSQLNTLTGTDFDLSIGEMPVNITGKPRTAMVINGGLPGPLLRWKEGDTVTLRVRNNVRDHTSIHWHGIILPPNMDGVPGLSFAGIEPDGMYVYKIHVKQNGTYWYHSHSGFQEQAGVYGPLVIEAKDPEPFAYDRDYVVMLTDWTDEDPASLMRKLKKQSDYYNYNKRTVGDFIEDVHKQGWSATMADRKMWAEMKMNPTDLADVSGATYTYLLNGHAPNTNWTGVFRPGEKIRLRFINGSSMTYFDMRIPGLKMTVVASDGQYVKPVTVDELRIAVAETYDVIVEPTEQAYTLFAQSMDRTGFARGTLAVREGLLAPVPPLDPRPLVTMADMGMGGMDHGSMGDMGSMQGMEGMDHGAMGAGDKGMDSMSGAPMQGMDGGQTQGMDHSKMSGMDHGSMGDMAGMAGMSGMGDMPMQAHPATEKDNPLVDMQAMSPTPKLDDPGLGLRNNGRRVLTYSDLRSTFEDPDGREPGRTIELHLTGHMEKFAWSFNGVKFADAEPLRLKYGERVRVVLVNDTMMTHPIHLHGMWSDLEDENGNFMVRKHTIDMPPGSKRSYRVTADALGRWAYHCHLLFHMEMGMFREVRVEE

SEQ ID NO: 25314 - protein, 357 aa, Gallus gallus
LPKIIDCVGSDGKERRQLVKGRDDLRQDAVMQQVFQMCNTLLQQNTETRKRKLTIRRYKVVPLSQRSGVLEWCSGTTPIGEFLVNADQGAHKRYRPHDYSGFLCQKIMMDAQKKHSEEKYNIFMKVCDNFQPVFRYFCMEKFRDPAVWFEKRLAYTRSVATSSIVGYILGLGDRHVQNILIDEQTAELVHIDLGVAFEQGKILPTPETVPFRLTRDIVDGMGITGVEGVFRRCCEKMAVMRNSQEALLTIVEVLLYDPLFDWTMTPLKALYLQQGPEDEADMSSTLGADPQACKRKASDDQSFNKVAERVLMRLQEKLKGVEEGTVLSVGGQVNLLIQQAMDPKNLSRLFPGWKPWV

SEQ ID NO: 25315 - protein, 464 aa, Trypanosoma brucei
MSTRKEPPKVLKGAAYTECSPISDVSHHKASASKAFLENHYRGMLRDTRSGNTARPVGPRPREPCVDDFVLVKRIGKGAFGEVYLCYKKYDNDKQLYALKRMRKTDMIRKKQISHVRSEKDVMAEAASTNPWVVKLYLSFQDEQYLYMVMEYMPGGDMISWLCIKQRFDVESTRFYIAELCAAVASVHDMFFVHRDIKPDNILLDAKGHIKLTDFGLSKRFAKVGEELLDLEEGNDALCSSNSSANLSNTYGSTCQGPNSVPVVSPHNPHSPTANYNSLTPAGSHASAHPQARRIFESIVGSPGYIAPEILMRQRYGVNCDWWSVGVIMYEMLYGIPPFFSSDTSSTCHKITHWREYLTYPSDRGVPPEATDLLRRLMCDQRDRLDFQGVKEHPFFNDIDWERLRETPPAFVPELSDPLDTHYFPEVEDNTPHQHHQRPEERNAVREVDPRGVIFADYKFNLKR

SEQ ID NO: 25316 - protein, 140 aa, Mycobacterium bovis
VRNGIDFKIADLSLADFGRKELRIAEHEMPGLMSLRREYAEVQPLKGARISGSLHMTVQTAVLIETLTALGAEVRWASCNIFSTQDHAAAAVVVGPHGTPDEPKGVPVFAWKGETLEEYWWAAEQMLTWPDPDKPANMIL

SEQ ID NO: 25317 - protein, 181 aa, Mycobacterium bovis
LVRTRFETDKDKWTKIAESVKGVTEETTTGVLRLYQFAAAGDLAFPAINVNDSVTKSKFDNKYGTRHSLIDGINRGTDALIGGKKVLICGYGDVGKGCAEAMKGQGARVSVTEIDPINALQAMMEGFDVVTVEEAIGDADIVVTATGNKDIIMLEHIKAMKDHAILGNIGHFDNEIDMAGL

SEQ ID NO: 25318 - protein, 409 aa, Hordeum vulgare subsp. vulgare
MEPVFSLLEEAMPEPDSNPGRTSPPQLQAHVLAGGVRGAGGVGVGEIVGDGATELCFDKSMEEPSLLNVPTEPVANPDASTLHPNPTAEVSRKRRYDVHEEEEVVGVIPTPPAAGAVLDPVGYNAMLRRKLDAHLAAVAMWRTTRGICRQSSHDNRASQNPDSIQGSENHTGDASVQQLSSSSWEPSPSDDDMEGEAQTIGTMNISAEKVNKRKESNRDSARRSRSRKAAHTKELEEQVSLLRVANNSLMRHLADVSHRYVNTAIDNRVLKANVETLEAKVKMAEETMKRITSTNNFPQAISGMSSLRTHFSGSQLDGIFDTTLPTQNMSLNHFSTTATNFDVSSNYIPELAPAYQIHDQISSLHTQPMPCLDHHPRRMPFGIPSTLVPTPQRESTTLDSNEIGNMVMQ

SEQ ID NO: 25319 - protein, 319 aa, Oryza sativa (japonica cultivar-group); identical to SEQ ID NO: 3229

SEQ ID NO: 25320 - protein, 685 aa, Saccharomyces cerevisiae
MTDITPVQNDVDVNGNNVNDDVSSNLKRPIDQGDPSNGLAEEENPANNQLHLKKARLDGDALTSSPAGLAENGIEGATLAANGENGYNATGSREDEQQGLKKEEGGQGTKQEDLDENSKQELPMEVPKEPAPAPPPEPDMNNLPQNPIPKHQQKHALLAIKAVKRLKDARPFLQPVDPVKLDIPFYFNYIKRPMDLSTIERKLNVGAYEVPEQITEDFNLMVNNSIKFNGPNAGISQMARNIQASFEKHMLNMPAKDAPPVIAKGRRSSAQEDAPIVIRRAQTHNGRPKRTIHPPKSKDIYPYESKKPKSKRLQQAMKFCQSVLKELMAKKHASYNYPFLEPVDPVSMNLPTYFDYVKEPMDLGTIAKKLNDWQYQTMEDFERDVRLVFKNCYTFNPDGTIVNMMGHRLEEVFNSKWADRPNLDDYDSDEDSRTQGDYDDYESEYSESDIDETIITNPAIQYLEEQLARMKVELQQLKKQELEKIRKERRLARGSKKRGKRSKGRSGSKNASSKGRRDKKNKLKTVVTYDMKRIITERINDLPTSKLERAIDIIKKSMPNISEDDEVELDLDTLDNHTILTLYNTFFRQYESSSGASNGLDGTSGVTRDASSLSPTSAGSRKRRSKALSQEEQSRQIEKIKNKLAILDSASPLSQNGSPGQIQSAAHNGFSSSSDDDVSSESEEE

SEQ ID NO: 25321 - protein, 275 aa, Glycine max; identical to SEQ ID NO: 1619

SEQ ID NO: 25322 - protein, 252 aa, Gnetum parvifolium
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRNLMGEDLGPLNIKELQSLEQQLEVALGHVRNRKTQLLIQTIDELRDKERTLQEVNKSLQKKLSETEGRNVIPALPHATTGSGEWESSTLTTTYALQTQQPSGIHHVDCEPTLHIGPYHQAVHHEAIPGPPATHSEPHNQYIWWV

SEQ ID NO: 25323 - protein, 283 aa, Pisum sativum
MDPSSQQMSRQSSMENMLVCSKEQQESKPKPQPEQALKCPRCDSTNTKFCYYNNYSLTQPRYFCKSCRRYWTKGGTLRNVPVGGGCRKNKRSSSSKRIQDQAFAPNHNPFSNLPHFDQSNDFALRLARLQKQSCGGQMGYDENELSMLGNSGSSMNQSMSINHGFMDAIRSGLFLGNGMHYNNSVQNMYGGGYGNGDNGEVNSGNNNCGVSEEMMFNYDQEMSHCNAAINMKQEQSESRVFGGFPWQINGGIGNMGEVEQARASWNNGFTTPSWQGLLHSPLM

SEQ ID NO: 25324 - protein, 437 aa, Petunia x hybrida
MNTNRAVLVPHRGEVGGKQKNGQADGRNNRRVLGDIGNLVTGAPVIEGKPKAQISRPATRSFCAQLLANAQAEKNKVKPLAEVVNKVPAKKKASDKPAVQEAVIVISPDEEVKKKTIEKSPLSKRKAKKTGKTLTSTLTARSKAACGLSNRPKNEIDDIDAADAANHLAVVEYVEDIYNFYKLTEDESRVNNYMEFQPELNHKMRAILVDWLIEVHRKFELMPESLYLTINILDRFLSMKTVPRKELQLVGISAMLIACKYEEIWAPEVNDFMHISDNVYTRDHILQMEKAILGKLEWYLTVPTPYVFLVRYIKAAMPSDDQEIQNMAFFFAELGLMNYTTTISYCPSMLAASAVYAARGTLNKGPLWTPTLQHHTGYSEEQLMECTKQLVSYHKGAAESKLKAIYRKFSSPDRGAVALFPPARNLLPTTTTTTTSS

SEQ ID NO: 25325 - protein, 245 aa, Rhizobium sp. N33
MFELTGRKALVTGASGGIGEAIARVLHAQGAIVGLHGTRVEKLETLAAELGDRVKLFPANLSNRDEVKALGQKAEADLEGVDILVNNAGITKDGLFVRMSDADWDTVLEVNLTAVFRLTRELTHPMMRRRHGRIINITSVVGVTGNPGQTNYCASKAGMIGFSKSLAQEIATRNITVNCVAPGFIESAMTDKLNDKQKEAIMAAIPTRRMGTSVEVASAVAYLASNEAAYVTGQTIHVNGGLAMI

SEQ ID NO: 25326 - protein, 256 aa, Uromyces viciae-fabae
MTFTIDLKDQCIIVTGGNRGIGLAMSQACADAGAAVGIIYNSAKDAEDRASEISKKYGVKCKAYQCDVGQQHKVKEVFKKINEELGPVTGLIANAGVSVVKEALQYNKDDFNKIFDVNVFGVFNCAQAMAQIWTDTGFQRGSVVIISSMSSQICNRPLTQCFYNSSKAAVSNLGKCLAAEWAEKSIRVNMLSPGYVKTDQTSHMDQKLRDFQADGVPLKRFAEPEEMAGQAILLLSPKASYMTGGEYFVDGGNLVW

SEQ ID NO: 25327 - protein, 1099 aa, Candida albicans
MLESLNRRNSIDSNQADNDNDNDNHSNDELSPSELYYSPSGSPPKSQLLLRKSSSPSSYSPIKSDLPNIYSHLRSNDSESPPQPSPKQQSSLSSSSSSSSSSNTKSSTTKNIFKKLLRINKSSDNIDESRSIVSNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFVLDDIKSIYIQNEGSGYREELNISQKLEKNWITIIYFNHKKNSLKSLHLITDNDHDFKKLISAIYNLKQLRSQLAKEFLIDLNELDENYVKMLLNKELLAGDNGNVDGNEVDIRKSHKHVREFLSFNDILKYSKRLNINVNTNHLQQIFDQVLLLSSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPSGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYSSIFIKIEYDEDLLNEFINK

SEQ ID NO: 25328 - protein, 299 aa, Bombyx mori
MGFVKVVKNKQYFKRYQVKFKRRREGKTDYYARKRLVVQDKNKYNTPKYRLIVRLSNKDVTCQVAYSRIEGDHIVCAAYSHELPRYGVKVGLTNYAAAYSTGLLLARRLLQRLGLDTLYTGTTDVTGDEYNVEPVDNGPGAFRCYLDVGLARTTTGRRVFGAMKGAVDGGLNVPHSIKRFPGYDAESKKFNAEVHRAHIFGLHVAEYMRSLEQDDEDSFKRQFSKYIKLGVTADAIEAIYKKAHEAIRADPSHKKKELKKDSVKQKRWNKRKLTLAERKNRIKQKKASFIKRLQAQAEA

SEQ ID NO: 25329 - protein, 271 aa, Dunaliella salina
MGYVKVVKTSPYFSRYQVKYRRRRQGKTDYRARLRLVRQDKNKYNTHKYRLVVRFSNKNVTCQIVYSTIQGDVVMAAAYSKELPNYGLKVGLTNYSAAYCVGLLVARRILTKLNLADTYKGQEEPDGEDYNVEPVEDGPKPFYCLLDTGLKRTSTGSKVFAAMKGALDGGLDIPHNEKRFVGYADKKLDTEVLQKYIYGGHVAEYQETMQEEEPEKYQAHFSSYVENEIEPDGIEDMYKEVHAKIRENPCPPKKERTKPADAKRWSPQAHL

SEQ ID NO: 25330 - protein, 297 aa, Helianthus annuus
MGFVKVVKNKQYFKRYQVKFKRRREGKTDYFARKRLIAQDKNKYNTPKYRLVVRFSNRDITCQVAYSRIEGDKILCAAYAHELPQYGVKVGLTNYAAAYCTGLLLARKLLSQLGLDKLYIGSTEVTGEEFNVKPVEDGPGAFRCYLDVGLMRTTTGARVFGAMKGAVDGGLNILHSTKRFPGFDSESKEFNADVHRQHIFGQHVAEYMRQLAEEDDEAYKRQFSQYIKLGLNADAIEGLYKKAHEAIRANPARKTVAKKAHPKKRWTEKKLTREQRQGKVAAAKAEWLKKIEAGEVE

SEQ ID NO: 25331 - protein, 500 aa, Homo sapiens
MATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 25332 - protein, 433 aa, Xenopus laevis
MSDKLSYKVADISLADWGRKAIEIAENEMPGLMKMREMYSESKPLKGARIAGCLHMTLQTAVLIETLTAIGAEVQWSSCNIFSTQDHAAAAIAKTGVPVYAWKGETDEEYIWCIEQTIYFKDGKPLNMILDDGGDLTNLVHTKYPQLLKGIKGISEETTTGVHNLYKMKSSGTLQVPAINVNDSVTKSKFDNLYGCRESLIDGIKRATDVMIAGKVAVVAGYGDVGKGCAQALRAFGARVLITEIDPINALQAAMEGYEVTTMDEASKEGNIFVTTTGCADIVEGRHFENMKDDSIVCNIGHFDVELDVKWLNDNAAKKINIKPQVDRYLLKNGRHIILLAEGRLVNLGCAMGHPSFVMSNSFTNQVMAQIELWTNTDKYPVGVYFLPKKLDEAVAAAHLDKLGVKLTKLTDKQAKYLGLDKEGPFKPDHYRY

SEQ ID NO: 25333 - protein, 432 aa, Anopheles gambiae
MAKPAYKVADISLAEFGRKEIVLAENEMPGLMACRQKYGPLKILRGARIAGCLHMTIQTAVLIETLIELGAEVQWSSCNIFSTQDHAAAAMVKAGVPVYAWKGETDEEYMWCIRQTLIFPDGKPLNMILDDGGDLTNLVHAEHPELLKEIRGLSEETTTGVHNLYKMFREGRLGMPAINVNDSVTKSKFDNLYGCRESLLDGIKRATDVMIAGKVCVVAGYGDVGKGCAQALRGSGGRVLITEIDPINALQAAMEGKEVTTMEEASKEAQIFVTTTGCTDIIMGEHFLNMKDDSIVCNIGHFDCEINVTWLQENAVEKVNIKPQVDRYRLANGNHIILLAEGRLVNLGCAMGHSSFVMSNSFTNQVLAQIELWTNREQYAIGVHVLPKKLDDEVAALHLDKLGVKLTKLSARQPEYLNLPVEGPYKPEHYRY

SEQ ID NO: 25334 - protein, 485 aa, Mesembryanthemum crystallinum
MALAVEKTSSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGAGGGPDLIVDDGGDATLLIHEGVKAEEEYEKNGTIPDPTSTDNPEFQLVLGLIRDSLKVDPKRYHKMKTRLVGVSEETTTGVKRLYQMQATGTLLFPAINVNDSVTKSKFDNLYGCRHSLPDGLMRATDVMIAGKVGVVCGYGDVGKGCALALKAAGARVIVTEIDPICALQALMEGFQILTLEDVVSEADIFVTTTGNKDIIMVDHMRKMKNNAIVCNIGHFDNEIDMLGLENYPGVKRITIKPQTDRFVFPETNTGIIVLAEGRLMKLGCATGHPSFVMSCSFTNQVIAQLELWNERASGKYEKKVYVLPKHLDEKVAALHLGKLGAKLTKLSKDQADYISVPVEGPYKPAHYRY

SEQ ID NO: 25335 - protein, 421 aa, Pyrococcus horikoshii
MDCGRDYCVKDLSLADEGWKKIDWVSRFMPVLQHIRREFEEKKPFKGVRIAATLHLEMKTAFLLLTLKAGGAEVSAAASNPLSTQDDVVAALAKAGVKVYAIRGESKEQYYEFMHKALDIRPNIIIDDGADMISLVHKERQELLDEIWGGSEETTTGVIRLRAMERDGVLRFSVIAVNDSYMKYLFDNRYGTGQSTWDGVMRATNLLIAGKNVVVVGYGWCGRGIAMRARGLGATVIVVEVDPIKALEARMDGFLVMNMKEAAKIGDIFITATGDIKCIRREHFELMKDGAIMANAGHFDVEIWKPDLEELAVEISNPRPNVTEYKLKDGRRLYLLADGRLVNLVAADGHPAEIMDMSFALQAKAAEYIKDNHGKLEPRVYILPREIDEMVARIKLASMGIEIEELTEEQKKYLESWEHGT

SEQ ID NO: 25336 - protein, 463 aa, Rhodobacter sphaeroides
MADFIVKDLSLADFGRKELDIAETEMPGLMALREEFGASKPLKGARIAGSLHMTVQTAVLIETLVALGADVRWASCNIFSTQDHAAAAIAASGVPVFAIKGETLEDYWAYTDKIFQFADGTCNMILDDGGDATLYILLGARVEAGETDLIAVPQSDEEVCLFNQIRKRMAETPGWFTKQRDAIKGVSEETTTGVHRLYDLHKKGLLPFPAINVNDSVTKSKFDNKYGCKESLVDGIRRATDVMMAGKVAVVCGYGDVGKGSAASLRGAGARVKVTEVDPICALQAAMDGFEVVVLEDVVQDADIFITTTGNRDVIRIEHMREMKDMAIVGNIGHFDNEIQVAALKNHKWTNIKDQVDMIEMPSGSRIILLSEGRLLNLGNATGHPSFVMSASFTNQVLAQIELWTKGADYQPGVYILPKALDEKVARLHLKKIGVKLTDVRPEQADYIGVKVEGPFKAEHYRY

SEQ ID NO: 25337 - protein, 131 aa, Antirrhinum majus
MDTSKGEGKRVIKLPGSQEQGEEEDDIGEDSKKTRALTPSGKRASGSTQRSCQVENCAAEMTNAKPYHRRHKVCEFHAKAPVVLHSGLQQRFCQQCSRFHELSEFDEAKRSCRRRLAGHNERRRKSSHDTH

SEQ ID NO: 25338 - protein, 472 aa, Homo sapiens
MATKCGNCGPGYSTPLEAMKGPREEIVYLPCIYRNTGTEAPDYLATVDVDPKSPQYCQVIHRLPMPNLKDELHHSGWNTYSSCFGDSTKSRNKLVLPSLISSRIYVVDVGSEPGPQKLHKVIEPKDIHAKCELACLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPSATQGFVGCASAPNIQRFYKTREGTWSVEKVIQVPPKKVKGWLLPGVPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWEKQFYPDLIREGSVMLQVDVDTVKGGLKLNPNCLVDFGKEPLGPALAHELRYPGGDCSSDIWI

SEQ ID NO: 25339 - protein, 299 aa, Mus musculus
MDLVLSAADYYFFTPYVYPATWPEDNIIRQTISLLIVTNLGAYILYFFCATLSYYFVYDHSLMKHPQFLKNQVSREIVFTVKSLPWISIPTVSLFLLELRGYSKLYDDIGDFPNGWIHLMVSVVSFLFFTDMLIYRIHRGLHHRLVYKRIHKPHHIWKIPTPFASHAFHPVDGFLQSLPYHIYPFVFPLHKVVYLGLYVLVNVWTISIHDGDFRVPQILRPFINGSAHHTDHHMFFDYNYGQYFTLWDRIGGSFKHPSSFEGKGPHSYVKNMTEKESNSFAENGCKGKKVSNGEFTKNK

SEQ ID NO: 25340 - protein, 338 aa, Astragalus bisulcatus
MSSPLITDFLHQAGRAAVIAGGLGTELQRHGADLNDPLWSAKCLLSCPHLIRQVHLDYLENGADIIITASYQATIQGFKAKGFSDEEGEALLRRSVEIAREARDLYYQRCAESSSDNGDDSRILKQRPILIAGSVGSYGAYLADGSEFSGNYGDAIKSETLKDFHRRKVQILADSGVDLLAFEAVPNKLEAQAYADLLEEENIITPAWFAFTSKDGNNVVSGDSIEECGSIAESCDKVVAVGINCTPPRFIHDLILLLKKVTAKPIVIYPNSGETYDAIRKEWGQNSGVTDEDFVSYVDKWCESGASLVGGCCRTTPDTIRGIYKILSSGQSPTFSAK

SEQ ID NO: 25341 - protein, 323 aa, Arabidopsis thaliana
MVSVSLADNNEEKSTDLKKFKGGVTDHSISKANDNDHDDDDHDQDDDNDGDHDDDDHDDDNDHDDDNNDHDDDDNNDDNNDGDDDHDDDNNDDGDDEKKTLRIDTVFCGVTLARVASKKEKAAANDGKNTIHGGTKESSDVIWRVKKHKHNGKKPYIVFTYTTSPDGDQGKLEVTVTYKLVGENRLKMVMQAKAKEKTTPLNLVHRSYWNLGGHNNEDIFSEEIQILGSGYTHLDDNLTPTGKILAVKGTPFDFRQLRPIKDNINELKTGYGINYCLDGVANKMRKVVELVDNKSKIKMELSTDQSGLRLKTTKPKNGSVHKA

SEQ ID NO: 25342 - protein, 510 aa, Asarina barclaiana
MENGDHRTAPAFQLQQASPPEAAPVRNIILVAAIAAGVQFGWALQLSLLTPYVQLLGIPHTWTAFIWLCGPVSGMLVQPIVGYYSDNCTLRFGRRKPFIAGGAGLVVVAVFLIGFAADIGYAAGDTLGKGTKPRATAVFVVGFWILDVANNMLQGPCRALLADLSGGNARKMSNANALYSFFMAVGNVSGYAAGSYTHLFKIFPFSKTKACDVYCANLKSCFFISVALLLCVSALALTIVRETPPPETAEAPEATKKKKIPVFGELFSALKNLPRPMWFLLLVACLNWIAWFPFLLFDTDWMGKEVYGGTVAEGKMYDRGVRAGALGLMLNPVVLGFSSLGIQAIARGVGGPKRLWGGVNFLLAVCLALTVVITKQAEHSRLYTVGADGVQILLPPVPGVKISALALSGVLGIPLAVTFSIPFALASIYSSNYGAGQGLSLGVLNLAIVIPQMVVSVASGPLDALFGGGNIPAFVMGAVAAAVSGIFAVTMLPALPADASTKNLSVGSFH

SEQ ID NO: 25343 - protein, 389 aa, Oryza sativa (indica cultivar-group); identical to SEQ ID NO: 3145

SEQ ID NO: 25344 - protein, 501 aa, Sphingomonas chungbukensis
MATQLKSTENDYGIKSEYGHYIGGEWIAGDSGKTIDLLNPSTGKVLTKIQAGNAKDIERAIAAAKAAFPKWSQSLPGERQEILIEIARRLKARQSHYATLETLNNGKPMRESMFFDMTQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVESYLQLATEEGAEVLTGGTRADAANLAGGNFIKPTVFTNVKNTMRIAQEEIFRPVTTVISWNDQTHMMQQANATTYGLAGGVWTKDLARAHRIARQLETGTVWINRYYNLKANMPLGGYKQNGFGREFSHEVLNHYTQTKSVVVNLQEGRVGMFDQ

SEQ ID NO: 25345 - protein, 508 aa, Cricetulus griseus
MSRFVQDLSKAMSQDGASQFQEVILQELELSVKKELEKILTTATSHEYEHTKKDLDGFRKLYHRFLQEKGPSVDWGKIQRPPEDSIQPYEKIKARGLPDNISSVLNKLVVVKLNGGLGTSMGCKGPKSLIGVRNENTFLDLTVQQIEHLNKSYNTDVPLVLMNSFNTDEDTKKILQKYNHCRVKIYTFNQSRYPRINKESLLPVAKDVSSSGESTEAWYPPGHGDIYASFYNSGLLDTFLEEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 25346 - protein, 508 aa, Sus scrofa
  unsure (1)..(508): unsure at all Xaa locations
MSRFVQDLSKAMSQDGASQFQEVIRQELELSVKKELEKILTTAPSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGRPCEFVMEATNKARADVKGGTLTQYEGKLRLVEIAQVPKPHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIXNHGDRIDIPPGAVLENKIVSGNLRILDH

SEQ ID NO: 25347 - protein, 473 aa, Hordeum vulgare
MAAAAVAADSKIDGLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLIHNQNEYCMEVTPKTLADVKGGTLISYEGRVQLLEIAQVPDEHVDEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDI

SEQ ID NO: 25348 - protein, 471 aa, Pyrus pyrifolia
MAAVATGNVDKLKSDVASLSQISENEKNGFINLVSRYVSGEEAQHVEWSKIQTPTDEVVVPYDGLAPTPEDPEEIKKLLDKLVVLKLNGGLGTTMGCTGPKSVIEVRNGLTFLDLIVIQIENLNNKYGSCVPLLLMNSFNTHDDTQKIVEKYSKSNVQIHTFNQSQYPRLVVEDFSPLPSKGQTGKDGWYPPGHGDVFPSLKNSGKLDLLLSQGKEYVFIANSDNLGAVVDLKILHHLIQKKNEYCMEVTPKTLADVKGGTLISYEGRVQLLEIAQVPDQHVNEFKSIEKFKIFNTNNLWVNLNAIKRLVEADALKMEIIPNPKEVDGVKVLQLETAAGAAIRFFNHAIGINVPRSRFLPVKATSDLLLVQSDLYTLQDGFVTRNSARKNPENPTIELGPEFKKVGSYLSRFKSIPSILELESLKVSGDVWFGAGVVLKGKVTITAKSGVKLEIPDNAVIANKDINGPEDL

SEQ ID NO: 25349 - protein, 637 aa, Cucumis sativus
MMESCDCIDAQWPPDELLVKYQYISDVLIALAYFSIPLELIYFVQKSAFFPYRWVLMQFGAFIVLCGATHFINLWTFSMHSKAVAVVMTVAKVACAIVSCATALMLVHIIPDLLSVKTREMILKNKAEQLDREMGLILTQEETGRHVRMLTHEIRSTLNRDTILKTILVELGKTLGLEECALWMPSRNGLSLQLSHALNYQIPVGTNIPINLPVVNEVFNSNRAICVPYTCQLARVRTSVGGRYLPPEVVAVRVPLLNLSNFQMNNWPDGSSRSYAIMVLILPTDSARKWRDHELELVDVVADQVAVALSHAAILEESMRARDQLVDQNVALDLARREAETAIHARNDFLAVMNHEMRTPMHAIIALSSLLLETELTPEQRVMIETILKSSNLLATLINDVLDLSRLEDGSLVLDMGSFNLHAIFKEALDLVKPIASVKKLSMALILASDLPICAVGDEKRLMQIILNIVGNGVKFTKEGHVSIIASVAKLDSLRDWRPTEFYPMQSDGQFYLRVQVKDSGCGIPPQDIPHLFTRFTQLQTRSNKTNSGVGLGLALCKRFINLMGGHIWIESEGPDKGTTAVFIVKLGICNANPNDLSVKQVVPIVNHRSADLHGQRPIFRETGQVSFSSSRYQRSL

SEQ ID NO: 25350 - protein, 188 aa, Cucumis sativus
MTQVAAKGLDLEITELRLGLPGDCCSLISTSKNNEKKRVFSEVEVEDKSRSKGEDEGRRKQVVGWPPVCSYRRRNSFKGKGEQCESEEIMNMGMKKQMYVKVSFEGTPFLRKVDLGMVKGYGDLVGAMEKLFGSPIGCYEYTVTYEDRDGDWMLVGDVPWKMFIESCKRLRIMKKTEGKGSEMNSLSQ

SEQ ID NO: 25351 - protein, 355 aa, Cucumis sativus
MSPPLLDVGEVEESRSNVTLLASSNSMESVSPNNLEFEERNYMGLSDSSSEDSCMTATKSDGNKPSLNLKATELRLGLPGSESPERDPDNCLRSSSQLDEKPLFPLHPSSDGLYSSPQKTVVSGNKRGFSDAMNEFSEEKYHANIGLKAGSLLENLGSQMGKVKEPTTQKAVQERPQENSESRPSHNETANNNTSTPVSKAQVVGWPPIRSFRKNTLATTSKNNDEVDGKAMAGALFIKVSMDGAPYLRKVDLRNYSAYQELSSALEKMFSCFTIGQYGAHGALGMEKMSESKLKDLLHGSEYVLTYEDKDGDWMLVGDVPWEMFIDSCKRLRIMKSSDAIGLAPRAVEKCRNRS

SEQ ID NO: 25352 - protein, 180 aa, Cucumis sativus
TELRLGLPGTSPDDQSNSPINRTNSNKRALPSDDQNSSESRREINSDTSKCSQENTPPTKAQVVGWPPVRSFRKNSLQAKKKEETAAGMFIKVSMDGAPFLRKVDLKIYQGYPDLLQALENMFKFSLGKFCEREGYNGSEFVPTYEDKDGDWMLVGDVPWEMFMSSCKRLRIMKRLRIMK

SEQ ID NO: 25353 - protein, 483 aa, Suberites domuncula
MSEPHPFSSQYKLDKDLGKGAFSVVKKAIQKPNKHEYAVKIINTRKLTSRDLQKHEREARICRMLQHENIVQLHHVFQEDHVRYMIFDLITGGELFDDIVAREFYSEKDASKCIQQILESVKYCHDRRIIHRDLKPENLLLASKTPGASVKLADFGLAVEAMDARHYYGFAGTPGYLSPEVLNKQPYSYTVDIWACGVVLYILLVGYPPFWDDNQQRMFNVIKKGKFEYPSPEWDTVTADAKDLINKMLVVDQAKRISAKDALDHTWIKNCDRVASMVHRQETIVVLRKFNARRKLKAAVHTALLVTKRSSTFFSAKPSGQDKSAATMETVQEDDSGSHTAEEKEIVQATQRLINSIADKDYNEYSKLCTEDMTCFVPEACAQLVTGMEFHKFYFDHLPASTSAVQQSMITPKVQMLGDSGAYCAYIRLIQTMDKEGVAHSVTIPETRIWQKFGGDWRCVHSHRSSGGSNPPRSPDQSGQTGQ

SEQ ID NO: 25354 - protein, 214 aa, Paeonia sinjiangensis
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKHVQEVIAEMTDGGVDRSVECTGSIMAIISAFECVHD

SEQ ID NO: 25355 - protein, 214 aa, Paeonia sinjiangensis
IAESVGEGVTDLKPGDHVLPVFTGECKECRHCKSEESNMCDLLRINTDRGVMLNDGTSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 25356 - protein, 214 aa, Paeonia parnassica
IVESVGEGVTDLKPGDHVLPVFTGECKVCRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 25357 - protein, 214 aa, Paeonia arietina
IVESVGEGVTDLKPGDHVLPVFAGECKVCRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 25358 - protein, 214 aa, Paeonia officinalis
IVESVGEGVTDLKPGDHVLPVFTGECKVCRHCKSEESNMCDLLRINTDRGVMLNDGRSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 25359 - protein, 373 aa, Homo sapiens
GTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFLNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 25360 - protein, 402 aa, Bos taurus
MGCLGNSKTEDQRNEEKAQREANKKIEKQLQKDKQVYRATHRLLLLGAGESGKSTIVKQMRILHVNGFNGGEGGEEDPNAKSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQDDYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELLGGHHHHHH

SEQ ID NO: 25361 - protein, 384 aa, Mus musculus
MSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 25362 - protein, 460 aa, Sinorhizobium meliloti
MPVEILMPALSPTMEEGTLSKWLKNEGDKVSSGDVIAEIETDKATMEVEAVDKGTIGKLLIAAGTEGVKVNTPIAVLLQDGEAASDIDSMKTEAPKAETPKPAAAEAPAASAAPVAAQPKADVPSDPAIPAGTEMATMTVREALRDAMAEEMRANEDVFVMGEEVAEYQGAYKVTQGLLQEFGARRVVDTPITEHGFAGVGVGAAMTGLRPIVEFMTFNFAMQAIDQIINSAAKTLYMSGGQMGAPIVFRGPSGAAARVAAQHSQCYAAWYSHIPGLKVVMPYTAADAKGLLKAAIRDPNPVIFLENEILYGQSFEVPKLDDFVLPIGKARIHRTGKDATLVSFGIGMTYAIKAAAELEAQGIDVEIIDLRTIRPMDLPTVIESVKKTGRLVTVEEGYPQSSVGTEIATRVMQQAFDYLDAPILTIAGKDVPMPYAANLEKLALPNVAEVVDAVKAVCYK

SEQ ID NO: 25363 - protein, 256 aa, Lactococcus lactis
MGKLAIVTGSGQGIGEGIVYRLAKDGFAVAVADINPQTAKNVAKTLIDKGFEAKAYVLDVANRSAVFQLIEQAVSDFGELAVFVNNAGVAFIDSIIDSDSERVERLFDVNIKGTYWGIQAAATQFKKQGHGGRIINAASLASVEGSALQSAYSASKFAIRGLTQSAAKELAKDYITVNAYNPGIVRTAMRDEIDKKTAQIKGISIEQQQQNCLNEIYLGREGRPEDVAEVVAWFASDAAEYITGQSILVDGGMRFN

SEQ ID NO: 25364 - protein, 298 aa, Rattus norvegicus
MENFQKVEKIGEGTYGVVYKAKNKLTGEVVALKKIRLDTETEGVPSTAIREISLLKELNHPNIVKLLDVIHTENKLYLVFEFLHQDLKKFMDASALTGLPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 25365 - protein, 399 aa, Listeria monocytogenes
MQGKNILLAVSGGIAVYKAVALTSKLTQAGANVKVMMTAHAQEFVPPLSFQVLSKNDVYTDTFDEKKSSVVAHIDLADWADLVIVAPATANVIGKMANGIADDMVTTTILATEAPVWVAPAMNVHMIQHPAVIRNINRLYADGVRFIEPEEGYLACGYVGRGRLEEPEKIVLRIAEFFQEDKNLLQGKNVLVTAGATREKLDLIRYFTNHSTGKMGFSIAESAARHGANVTLITTSKALPVPHGVEAIYVESAEEMHQAVNERKVSQDIFVMTAAVADYTPAQVSDQKIKKQPGDFTIAMKRTKDILLEIGQHKTSEQVVIGFAAETENVEANARKKLTSKNADMIVANNISEAGAGFSGDTNIVTFYRKDGSSEALPILDKKEVAEHIIKEAANFLRK

SEQ ID NO: 25366 - protein, 382 aa, Hibiscus syriacus
MSSAGQVIRCKAAVAWEAGKPLSIEEVEVAPPQKDEVRIKILFTALCHTDVYYWECKGYTPLFPRILGHEASGIVESVGEGVTDVKPGDHVLPIFTGECKQCRHCLSEESNNMCDLLRINCDRGVMLADGKTRFSINGKPIYHFVGTSTFSQYTVVHVGQVAKINPTAPLDKVCPISCGICTGFGATVNVAKPKKGQTVAIFGLGAVGLAAAEGARICGASRIIAVDLNPRRFEEAKRFGITEFVNPKDYDKPVQEVIVEMTGGGVDRSVECTGSVQAMISAFECVHDGWGVCVLVGVPKKDDAFKTHPMNLLSERTLKGAFYGNYKPRTDIPMVVDKYLNKELGLDMDKFITHSVPFADINKAFDYMLQGIGLRCMIHLDA

SEQ ID NO: 25367 - protein, 905 aa, Azotobacter vinelandii
MLTLLPSCLLALVLGIYFTWQQLAEMHGNLVGRGQLIVSQLAPLAAPALAQNYHNRLQRIANRVLDQTDIRAVSFLDSELGTIVHAGPSLNGPLPPQDPTQLTMVRDNSATHLLMPVLGYHQNLASGSNDRDDHLLGWIALEISHHNALLQGYRNLLASLLLILSVLLVSAFLALRVGRSISDPLRRIQQGVSQLRDGHLETRLPSLRSHELDELAAGINRMAEVMQHAQEEMQNSIDQATEDVRQNLETIEIQNIELDMVRREALEASRIKSEFLANMSHEIRTPLNGIIGFTNLLQKCELTPRQHDYLNTIQKSADSLLDIINEILDFSKIEAGKLVLEHTPFNLRELIQDTLTILAPAAHAKHLELVSLIYRDTPLALNGDPQRLRQVLTNLISNAIKFTNEGTIAVRAMVEDIGEEFAQLRISVHDTGIGLSQEDLNALFQAFSQADNSLTRQAGGTGLGLVISKRLIEQMGGEIGVNSVPGEGSEFWIRLSLPLDDHSEDEPPTALHGHRVALLEQHELARQSIQHQLEDCGLEVQPFAELDSLLAGVAAARQEERPVGLAVLGVTSRDTSAEELAQRIADLERLGCKCLVLCPTTEQMFYQEVLPEAQIQLQSKPAHRDKLQAALGELLTPQPTGSQTLGPLGNRAPRLLCVDDNPANLLLVQTLLGDMGAAVTVADSGHAAVEAAQRERFDLIFMDVQMPGMDGRQATRAIRQWEAGQPEQRHTPIIALTAHALANERRALLQSGMDDYMTKPINERQLAQVVHKWTRLHLRSPGAQQVHEVQPASIGHLSVLDSEEGLRLAAGKPDLAADMLSMLLASLDADRQAIHQARRDGDRAALIERVHRLHGATRYCGVPQLRAACQHSETLLKQHAPAADTALDELDAAILRLAGEAKFGA

SEQ ID NO: 25368 - protein, 431 aa, Drosophila melanogaster
MSKPSYKVADISLAEWGRKAIIIAENEMPGLMACRKKYGPSKPLKGARITGCLHMTVQTAVLIETLVELGAQVQWSSCNIFSTQDNAAAAIAATGVPVYAWKGETDEEYMWCIEQTLVFPDGQPLNMILDDGGDLTNLVHEKFPQFLKNIKGLSEETTTGVHNLYKMFKEGRLGVPAINVNDSVTKSKFDNLYGCRESLIDGIKRATDVMIAGKVCCVAGYGDVGKGCAQALKGFGGRVIVTEVDPINALQAAMEGYEVTTMEEGSKEASIFVTTTGCRDIITSVHLQQMPDDRIVCNIGHFDIEIDVDWLNANAKEKVNVKPQVDRYTMKSGKHIILLAEGRLVNLGCADGHPSFVMSNSFTNQVLAQIELWTKSDKSVGVHVLPKILDEEVASLHLEKLGVKLTKLTEKQATYLGVSQTGPFKPDHYRY

SEQ ID NO: 25369 - protein, 219 aa, Drosophila melanogaster
MSCPRSIEIPDGSWIDWFLGIKGHEFSCRVPNEYIQDKFNLTGLEFDSQTLEVVLDPEFDNEDWDCAEEKKLYGMIHARYIVSPRGIEDMRLKYERGDFGSCPRVFCKRQKVLPVGLHDVWDKAQVKIYCPSCNNVYIPLPHNGMLDGAMFGTSFPHMFFMQLPSLIPSPPVEKYIPRIYGFQLHKKALMPPESAESPPIKVESSVSKSPSWLRNVPNF

SEQ ID NO: 25370 - protein, 349 aa, Lycopersicon esculentum
MGVQEKDPLLQLSLPPGFRFYPTDEELLVQYLCKKVAGHDFPLQIIGEIDLYKFDPWVLPSKATFGEKEWYFFSPRDRKYPNGSRPNRVAGSGYWKATGTDKVITSQGRKVGIKKALVFYVGKAPKGSKTNWIMHEYRLFESSRKNNGSSKLDEWVLCRIYKKNSSGPKPLMSGLHSSNEYSHGSSTSSSSQFDDMLESLPEMDDRFSNLPRLNSLKAEKFNLDRLDSANFDWAILAGLKPMPELGPANQAPGVQGQAQGHVNNHIHSDNNNMNFLNDVYAHPPNFRGNTKVESINLDEEVESGKRNQRIDQSSYFQQSLNGFSQAYTNNVDQFGIQCPNQTLNLGFKQ

SEQ ID NO: 25371 - protein, 249 aa, Oryza sativa
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 25372 - protein, 690 aa, Homarus americanus
MADLEAVLADVSYLMAMEKSKSTPAARASKKIVLPDPSVRSVMHKHLEKMGEVNFDKIFNQKLGYLLYKDFSENVCEDPVHQLKFYEEIKTYEKIENKEERRKVAREIYDNFIMKELLSNTHAYNKESVAFVQKHLTKNEVPTDLFEPYIEEIFTHLRGDLFNKFVESDKYTRFCQWKNLELNIQLTMNDFSVHRIIGRGGFGEVYGCRKADTGKMYAMKCLDKKRIKMKQGETLALNERIMLSLVSTGVDCPFIVCMTYAFHTPDKLCFILDLMNGGDLHYHLSQHGVFNEQEMRFYAAEVILGLEHMHRRYIVYRDLKPANILLDEHGHVRISDLGLACDFSKKKPHASVGTHGYMAPEVLSKGTAYDSSADWFSFGCMLYKLLKGHSPFRQHKTRDKHEIDRMTLTMNVELPDTFTQELRGLLEGLLHRDVDKRLGCKGKGADEVKEHPFFGGLDWQQVYLQKYQPPLIPPRGEVNAADAFDIGSFDEEDTKGIKLTEADQELYKNFPLVISERWQTEVAETVFDTVNLEADKVEHKRRAKHKFKFKLDADEKGSDCIIHGYIKKLGGPFTSAWQTRYAKLYPNRVELHSESSSGKPELIFMDQLDDVSSDFVQIKGENCIVLKTKDSKIVLTNPDEIGLKEWSMSLRSAHKMSLELLSNMAKKAGKIYGTEGNNKPSLMARNGNGN

SEQ ID NO: 25373 - protein, 419 aa, Mus musculus
MSGAARAGPARLAALALLTCSLWPTRADNASQEYYTALINVTVQEPGRGTPLTFRIDRGRYGLDSPKAEVRGQVLAPLPIHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRVLPCKHVFHKSCVDPWLSEHCTCPMCKLNILRALGIVPNLPCTDNVAFDMERLTRTQAVNRRAALGDLAGDSSLGLEPLRTSGISPLPQDGELTPRTGEINIAVTKEWFIIASFGLLSALTLCYMIIRATASLNANEVEWF

SEQ ID NO: 25374 - protein, 335 aa, Pseudomonas putida
MALSKEVPEFDIDDDVLLMETGIVLETDVVSDEPAVSSVRTRAKSGSSLKQHKYIDYSRALDATQLYLNEIGFSPLLSPEEEVHFARLSQKGDPAGRKRMIESNLRLVVKIARRYVNRGLSLLDLIEEGNLGLIRAVEKFDPERGFRFSTYATWWIRQTIERAIMNQTRTIPLPIHVVKELNVYSRAARELTQKLDHEPSPEEIATLLEKPVAEVKRMLGLNERVSSVDVSLGPDSDKTLLDTLTDDRPTDPCELLQDDDLSQSIDQWLGELTDKQREVVVRRFGLRGHESSTLEDVGLEIGLTRERVRQIQVEGLKRLREILEKNGLSSESLFQ

SEQ ID NO: 25375 - protein, 313 aa, Escherichia coli
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRL

SEQ ID NO: 25376 - protein, 313 aa, Escherichia coli
MSQNTLKVHDLNEDAEFDENGVEVFDEKALVEEEPSDNDLAEEELLSQGATQRVLDATQLYLGEIGYSPLLPAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRL

SEQ ID NO: 25377 - protein, 147 aa, Escherichia coli
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYAT

SEQ ID NO: 25378 - protein, 313 aa, Escherichia coli
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLNRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRL

SEQ ID NO: 25379 - protein, 303 aa, Escherichia coli
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVR

SEQ ID NO: 25380 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTELFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKERKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGFPKGMDPSQLIMEEKFGLTLQKEPPLYIVPKTRD

SEQ ID NO: 25381 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLRPMGIAWVFMVFSVICLLSFFFAFYMVPETKGKSLEEIEASLKKRFKKKKSTQNQVLNERTL

SEQ ID NO: 25382 - protein, 521 aa, Hebeloma cylindrosporum
MSPPKSSRGAPKFKWSHLWEPAIVNPVNLKSYTIPIFNLGDPYARAFHLSWLGFFVAFLSWFAFPPLIPDAIKSDLHLSAAQVANSNIIALCATFVVRVGVGPLVDQYGPRKVMAYLLILGAIPSGLAGTARSAEGLYVLRFFIGILGATFVPCQAWTSAFFDKNCVGTANALVGGWGNMGGGATFAIMTSLFQSLTQTYGLSTHVAWRAAFAIVPAPILLFVAVLTFIFGQDHPAGKWSERHTLPVAALAVQQGHQIPNIQPEKSLKSSSESSKDEKDPEGNAAVTVRPAIADEDLALVKSTVDVAINEPLTLKTTVKILTNPLTWLPALAYLTTFGVELAIDSKFADVLFVLFSKRRPGFDQTTAGYYTSILGLLNLVTRPAGGYFGDLVYRHYGTNGKKAWTLLCGLIMGAALVAGGFYMQNNRTSGDEQLSVLMGVFSVAAIFSEFGNGANFALVPHCNAYNNGVMSGLVGSFGNLGGIIFALVFRFQTEVGKAFWIMGVISIGINALLIPVSVPAL

SEQ ID NO: 25383 - protein, 352 aa, Cochliobolus heterostrophus
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAIFPKTNDLALDLLERLLAFNPVKRISVEDALKHPYLEPYHDPDDEPGADPIPEEFFDFDKNKDNLTKEQLKLLIYQEIMR

SEQ ID NO: 25384 - protein, 381 aa, Zea mays; identical to SEQ ID NO: 1187

SEQ ID NO: 25385 - protein, 404 aa, Mus musculus
MSRRSSRLQAKQHAQPNQPDSPQETQIIQAKKRKTAQDVKKRKEEITKKHQYEIRNCWPPVLSGGISPCIIIETPHKEIGTSDFSRFTNYRFKNLFINPSPLPDLSWACSQEVWQNMLQKENRYVHDKHFQVLHSDLEPQMRSILLDWLLEVCEVYTLHRETFYLAQDFFDRFMLTQKDVNKNMLQLIGITSLFIASKLEEIYAPKLQEFAYVTDGACSEVDILKMELNILKALKWELCPVTVISWLNLFLQVDAVKDVPKVLLPQYSQETFIQIAQLLDLCILAIDSLEFQYRILAAAALCHFTSIEVVKKASGLEWDDISECVDWMVPFVSVVKSVSPVKLKTFKKIPMEDRHNIQTHTNYLALLNEVNYVNIYRKGGQLSPVCNGGIMTPPKSTEKPPGKH

SEQ ID NO: 25386 - protein, 521 aa, Liza aurata
MALMILPFIGALSVSESLVALVTVCLVYLIIKSFQANIPEGLSRLPGPKPLPIIGNVLEVGSRPYLSLTEMSKRYGNVFQIQIGMRPVVVLSGNETVRQALIKQGDEFAGRPDLYSFRFISEGKSLAFSTDQAGVWRARRKLAYSALRSFSTLEGTTPEYSCVLEEHISKEAEYLIKQLDTVMKADGSFDPFRYIVVSVANVICGMCFGRRYDHHDRELLSLVNLSDEFGQVVGSGNPADFIPILQYLPNKTMKKFVNINDRFISFVQKIVSEHYATFNKDNIRDITDSLIDHCEDRKLDENANVQMSDEKVVGIVNDLFGAGLDTISTALSWSVMYLVAYPEIQERLYQELKENVGLDRTPVLSDRNNLPLLEAFILEIFRHSSFLPFTIPHCTTKDTSLNGYYIPKDTCVFINQWQINHDPELWKEPSSFNPDRFLSADGTEVNKVDGEKVMVFGLGKRRCIGEVIARNEVYMFLAILIQKLHFYNLPGEPLDMTPEYGLTMKHKRCHLRATVRVRSDH

SEQ ID NO: 25387 - protein, 740 aa, Homo sapiens
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 25388 - protein, 573 aa, Bacillus megaterium
MTKEIQGIAASSGIAIAKAFRLENPELTVEKKSVTEVEAEVARLEAALEKSKSELEIIREHARKELGDDKAEIFEAHLLVLSDPELINPIKDKITNENVNAEHALDEVAAMFINMFESMDNEYMKERAADIRDVTKRVLAHLLGVNVSNPSLISEEVVIIAEDLTPSDTAQLNRKFVKGFTTDIGGRTSHSAIMARSMEIPAVVGTKTVMEDIQNGVLVIVDGLDGEVIVDPSEETVKAYEKKAAEYAEQKAEWAKLVNEKTVSADDHHVELAANIGTPEDVKGVLENGGEGVGLYRTEFLYMGREDLPTEEEQFTSYKTVLERMEGKPVVVRTLDIGGDKELPYLNLPKEMNPFLGFRAIRLCLEMQDMFRTQLRALLRASVYGNLKIMFPMIATVDEFRQAKAILLEEKAKLQQEGVQVSEDIEVGMMVEIPSSAVIADLFAKEVDFFSIGTNDLIQYTLAADRMNERVSYLYQPYNPAILRLVNMVIKAAHKEGKWVGMCGEMAGDEIAIPILLGLGLDEFSMSATSILKARSQIRQLSKADIEPHLDTILSMSSTEEVIEFVKSTFHIG

SEQ ID NO: 25389 - protein, 578 aa, Bacillus sp. S
MGNAIREKTIHGIAASSGIAIAKAYRLETPDLAAEKRAVADVEAEVARFEAAVAKAKEELEAIKQHALEKLGEDKAAIFAAHLLVLDDPELLNPIKEKIQTERVNAEYSLDETASFFISMFEAMDNEYMKERAADIRDVTKRVLAHLLGVTISNPSLISEEVVIIAEDLTPSDTAQLNRQYVKGFATDIGGRTSHSAIMARSLEIPAVVGTKTVTAEVKNGDIVIVDGLDGQVIINPSPELLAQYEQKRARYEAQKAEWAKLVHEATVTADGIHVELAANIGTPDDVKGALANGAEGIGLYRTEFLYMGRSELPTEDEQFVAYKTVLEQMNGKPVVVRTLDIGGDKELPYLQLPKEMNPFLGFRAIRLCLEMQDMFRTQLRALLRASVYGNLKIMFPMIATLDEFRQAKAILLEEKEALLRQGVAVADGIEVGMMVEIPAAAVMADQFAKEVDFFSIGTNDLIQYTMAADRMNERVAYLYQPYNPAILRLISHVIDAAHREGKWVGMCGEMAGDPIAIPILLALGLDEFSMSATSILPARAQLKQLAKEEAARIKETVLSLGTAEEVVSFVKRTFSLA

SEQ ID NO: 25390 - protein, 575 aa, Lactococcus lactis subsp. cremoris
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTEQQSEFHKAGDAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKSKLIAEGVPVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 25391 - protein, 631 aa, Solanum tuberosum
MEGVLQTRGLLSLPSKPKIKAFYPLPQGGLRNRFNSLSSLKPNPLNGVSLSSNGFQKVQGFDTKPQLFGQKKRCFPICKAEAAAAAGAADGQPLFVEKEQPKFMGIELVTLKKIIPLGAMFFCILFNYTILRDTKDVLVVTAKGSSAEIIPFLKTWVNLPMAIGFMLLYTKLANVLSKEALFYTVILPFIAFFGAFGFVLYPLSNYFHPTAFADKLLNTLGPRFLGPIAILRIWSFCLFYVMAELWGSVVVSVLFWGFANQITTVDEAKRFYPLFGLGANVALIFSGRTVKYFSSLRSSLGPGVDGWAISLKGMMSIVVMMGGAICFFYWWVNRNVALPTRSKKKKVKPNMTTMESLKFLVSSKYIRDLATLVVAYGISINLVEVTWKSKLKAQFPSPNEYSSFMGDFSTATGIATFTMMLLSQWIFDKYGWGAAAKITPTVLLLTGVGFFSLLLFGAPLAPTLAKFGMTPLLAAVYVGAMQNIFSKSAKYSLFDPCKEMAYIPLDEDTKVKGKAAIDVVCNPLGKSGGALIQQFMILTFGSLASSTPYLGGVLLVIVLAWLGAAKSLDGQFTQLRQEEDLEKEMERASLKIPVVSQNENGNGPLSSESSLNPAGGDSTNASSEPSSPRSL

SEQ ID NO: 25392 - protein, 429 aa, Thermotoga maritima [sequence omitted]

SEQ ID NO: 25393 - protein, 318 aa, Trypanosoma brucei rhodesiense
MAVAYEGQLTGHRGWVTSLACPQTPETATKVVSTSRDKTLLSWGPNPDRHSSECSYGLPDRRLEGHSAFVSDVALSNNGNFAVSASWDHSLRLWNLQNGQCQYKFLGHTKDVLSVAFSPDNRQIVSGGRDNALRVWNVKGECMHTLSRGAHTDWVSCVRFSPSLDAPVIVSGGWDNLVKVWDLATGRLVTDLKGHTNYVTSVTVSPDGSLCASSDKDGVARLWDLTKGEALSEMAAGAPINQICFSPNRYWMCAATEKGIRIFDLENKDIIVELAPEHQGSKKIVPECVSIAWSADGSTLYSGYTDNVIRVWGVSENA

SEQ ID NO: 25394 - protein, 316 aa, Plasmodium falciparum (isolate 7G8)
MAKLSKQQKKQMYIEKLSSLIQQYSKILIVHVDNVGSNQMASVRKSLRGKATILMGKNTRIRTALKKNLQAVPQIEKLLPLVKLNMGFVFCKDDLSEIRNIILDNKSSSHPARLGVIAPIDVFIPPGPTGMDPSHTSFLESLGISTKIVKGQIEIQEHVHLIKQGEKVTASSATLLRKFNMNPSYGVDVRTVYDDGVIYDAKVLDITDEDILEKFSKGVSNVAALSRATGVITEASYPHVFVEAFKNIVALIIDSDYTFPLMKILKKWVENPEAFAAVAAPASAAKADEPKKEEAKKVEEEEEEEEDGFMGFGMFD

SEQ ID NO: 25395 - protein, 98 aa, Citrus maxima
MAGKEEEFDYKKEEKHHKHLEHLGGLGTAGAGAFPRLESHKAEKDPDHAHRHKIEEEIAAAAGLGSGGFAFHEHHEKKEAKEEDQEAHGKKSTTISFN

SEQ ID NO: 25396 - protein, 638 aa, Ralstonia solanacearum
MHNCPHGVPAGNGLAAQSEIHDPIHCTPLTASLRPLLNKLGLASRAPLELDARAKLLAAVHRGAPMGIAASVVLPVLTLAAFWDSDSRLALAGWCLIMLCLTASGLRFYFGYRYDITRMTLAAHTRKWWTGMRIMSAVGGVAWGSSAGLYLVSPSLEFSSLLMIVIIGVAAGAVLSQAPVPSNLLILGTGILAPHFALAEQAFPEHGLYVRGVLLFFAAFLARHAANIHSTLVREIQLENESRQLARRYQDEKQRALSASEEKSRFLAAASHDLRQPVHALVLLVEALRARNQSETLAPLVEQLPSGAQTIDLLFRSLLDLSKLESRKTSPTLEPVDLGEVITEVVQQFLPDARAKGLALTQRIPPLPVFGMAEPVLLRRALFNLLQNALRYTSHGGVMVALRVRQKHLRIEVWDTGIGIAPEHQKDIFSSYYQVENPERDPSQGLGLGLAIYKECVRLLRGTFGVRSVPGRGSMFWMALRPVPAEVKAPLAAQPRSEQKRAVLDQPRFSGVVLVVDDDAQIRKAWHALLEAWGVEVHSAADGPTADELLSRGLRPQIIFCDLRLPGKEDGLQLLERWQVSHPEAHAVLLTGDRNSAALARAEEAGYLLLAKPMDPNMLRVLLKRWLRGRAAEPQVAY

SEQ ID NO: 25397 - protein, 321 aa, Lycopersicon esculentum
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 25398 - protein, 624 aa, Filobasidiella neoformans
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPAKRSSSPSIQSSKTSSFQYLREVKGKVVKRRGAREA

SEQ ID NO: 25399 - protein, 489 aa, Artemia sp.
MKYLETFYSKNLYPTFLSNLDSHFRPQVSLKRKILIKNKRLKPEVEKIELELFRQGQFVIEDEEKEDAESPAALLQKRKRKRLQVRHLLVRFLQVRCDAPPINYSGSTTNVHPWLSSMINYAQPVKFQSFEHASQKNVHHNMSSFSEAAGLNLLKTSAIEFVNYNKRQMSRIYPKGTRADSSNYMPQVFWNAGCQMVSLNYQTPDLPFQLNQGKFEYNGNCGYLLKPDFMRRPDKAFDPFAESPVDGVIAAQCQVQVIAGQFLSSNKVGTYVEVDMYGLPTDTIRKEFRTRLIPANGLNPIYNEEPFLFRKVVLPDLAVLRFGVYDENGKLLGQRILPLDGLQAGYRHISLRTEANFPMSLPMLFCNVELKIYVPDGLGGLMDALSDPNAFLKQKQKQDDQMKAMGIEQTADGGVKGQAEEKREEMKFDPVTLESLRNDKGLPKATKKHQKDYETMKKKQLKDKLGIQKSQVTAIEKLCKKRNSCLIKF

SEQ ID NO: 25400 - protein, 105 aa, Medicago sativa
MADVEDRCFVGGLAWATDNDALEKAFSQYGEIVDSKIINDRETGRSRGFGFVTFANEKSMNDVIEAMNGQDLDGRNITVNQAQSRGSGGGGGGRGGGGYGGGGGG

SEQ ID NO: 25401 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVTFLAPDRTPLAHAGPSMLNQAPTGNGSQMLQRTGSDATRYLLPVFGRHRNLAGDLIPDESDRLLGWVELELSHNSMLLRGYRSLFASLMLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGLELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 25402 - protein, 225 aa, Mus musculus
RSLEGFNDVYLVTLSMGADLNRIVKCQKLTGDHVQFLIYQILRGLKYIHSADIIHRDLKPSNLAVTQVIELKLLDFGLARHTDDEMTGYVATRWYRAPEIMLNWMHYNRTVDIWSVGGFMAELLTGRTLFLGTDHINQLQQIMRLTGTPPAYLINRMPSHEARNYIQSLAQMPKMNFPNVFIGANPLAVDLLEKMLVLDSDKRITVAQALAHAYFAQYHDPYDEP

SEQ ID NO: 25403 - protein, 92 aa, Candida albicans
MAPGERKKSSRKKKDPDAPKRSLSAYMFFANENRDIVRAENPGISFGQVGKLLGEKWKALNSEDKLPYENKAEADKKRYEKEKAEYAKKNSA

SEQ ID NO: 25404 - protein, 947 aa, Saccharum officinarum
MAASVSGATICLQKPGSKGRRARDATSFARRSVAAPRSPHAAKASVIRSDAGAGRGQHCSPMRAVVDAAPIATKKRVFYFGKGKSEGDKSMKELLGGKGANLAEMSSIGLSVPPGFTVSTEACKQNQDAGSILPAGHWREILDGLQFVEEYMGATLGDPQRPLLLSERSGSRGVQAGMMDTVLNLGLNDEVAAGLAAKSGERFDYDTFRRFHDMYGNVVMDIPRSLIEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFPINAQGEDVVAGIRTPEDLDAMKDVMPQAYEELVENCNILESHYKEMQDMEFTVQENRLWMLQCRTGKQTGTGAVKIAVDMVSEGLAERRQAIKMVEPGHLDQLLHPQFENPAAYKDQVIATGLPASPGAAVGQIVSTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPSLSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGLPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 25405 - protein, 586 aa, Giardia intestinalis
MSDTDVRIKYAVTKTSSRGKKQPRSLVLTSKSVQNVMGNSIQWERPVQEIYGIHRSTKEPKAFVISFLQTYRFDVESADQVSSIVSAFQRLNLGEVFVDDKIGAYGLQTDKGKGYKKGHVNVSSDEDGDIGATGAVSQAADAPASSGQKDRPRTTILEDDLDENIEYVEDTRVLAHQIETLPETEVLETFCNPVAAYKFVRPPIFPQVPPSHAKVMRPQNFELVSVVGKGSFGKVFLVRRVEDNRFFAMKVLKKRNVLDRRQLEHLKAEHNILQSFNHPNMIKLYHSFQTRTRLFLVTTFATGGELFYHLKKIGRFPEPLAVFYLAQIVLVIEYLHKHDIVFRDMKPENLLLDNHGNILLTDFGLSKTGISADNSGGAGVCSGSFCGTPDYLSGEIISGVPHGKMVDIWALGALLFEMLVGSAPFSYASSTSTHGGNARSELYRRILKNIIVFPVFISAECKSFIAKCLSRRPKDRPNFDEIKKHEVFRKNKIDFDKLYRKEIQPPFKPKLEQSCILAVDGKLLKNPLDNIYRYIAPEALVVNFDAKFTSESPILPPSTQTDSVTMQEDKNFKDFAWTAQDAFDKL

SEQ ID NO: 25406 - protein, 105 aa, nitrogen fixing bacterium ANFK33
MKMIRAIVRPEMADMVSEGLAESGFYSMTKMAVFGRGKQKGLTAGNLHYDELPKTLIIIVVEDSSVDEVIKIIQYKAYTGNEGDGKIFTSPVEKVFTVRTGSNEL

SEQ ID NO: 25407 - protein, 123 aa, nitrogen fixing bacterium ANFK33
MKEIIAFIRPSKMAATKKILDKLEIPSVTAIPVLGRGNQRGLNTTLSGIDIHPQVLAKGRVLGMKYIPKRMLVIVAKDGDVDRIVESIIQVNWTGYIGDGKIFVCPTDDAVRIRTNESGDVAL

SEQ ID NO: 25408 - protein, 477 aa, Acinetobacter sp. NCIMB9871
MNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 25409 - protein, 374 aa, Rattus norvegicus
SNRVGKVIKCKAAVLWGTNQPFSIEDIEVAPPKAKEVRVKILATGICGTDDHVIKGTMVSKFPVIVGHEAVGIVESVGEEVTTVRPGDKVIPLFLPQCRECNPCRNPEGNLCIRSDLTGRGVLADGTTRFTCKGKPVQHFMNTSTFTEYTVLDESSVAKIDAEAPPEKACLIGCGFSTGYGAAVKTAKVSPGSTCAVFGLGGVGLSVIMGCKAAGASRIIGIDINKDKFQKALDVGATECINPRDFTKPISEVLSDMTGNTVQYTFEVIGRLETMVDALSSCHMNYGTSVVVGAPPSAKMLSYDPMLLFTGRTWKGCVFGGWKSRDDVPKLVTEFLEKKFDLGQLITHTLPFHNISEGFELLYSGQSIRTVLTF

SEQ ID NO: 25410 - protein, 329 aa, Gallus gallus
RSDDHVVTGALAMPFPIILGHEAAGVIESVGEKVTSLKPGDAVIPLFVPQCGECRSCLSTKGNLCIKNDLSSSPTGLMADGTTRFTCKGKAIHHFVGTSTFTEYTVVHETAAAKIDSAAPLEKVCLIGCGFSTGYGAVLQTAKVEAGSTCAVFGLGGVGLSVVMGCKAAGASRIIAVDINKDKFAKAKELGATECINPKDFKKPIHEVLTEMTGQGVDYSFEVIGRIETMTAALASCHNNYGVSVIVGVPPAAQKISFDPMLIFSGRTWKGSVFGGWKSKDAVPKLVADYMKKKFVLDPLITHTLPFTKINEGFDLLRTGKSIRSVLVL

SEQ ID NO: 25411 - protein, 374 aa, Oryctolagus cuniculus
MARSLAWRCCPWCLSEDEKAAARVDQEITRLLLEHRRQVRGELKLLLLGTGESGKSTFIKQMRIIHGAGYSEEDRKGFRPLVFQNIFLSVQAIIEAMDRLQIPYSRPESKLHASLVMSQDPYKVNTFETRYALAVQSLWRDAGVRACYERRREFHLLDSAVYYLSHLERIAEEGYVPTAQDVLRSRMPTTGINEYCFSVQKTNLRIVDVGGQKSERRKWIHCFEDVTALIFLASLSEYDQCLEENGQENRMQESLALFGTVLALPWFRATSVILFLNKTDILEDKVRTSHLATYFPGFRGPPQDPEAAKRFILELYTRVYAGAAAGPDGASKGPRSRRLFSHYTCATDTQNIRKVFKDVRDSVLARYLDEINLL

SEQ ID NO: 25412 - protein, 1054 aa, Nicotiana tabacum
MAGNDWINSYLEAILDVGPGIEDKKSSLLLRERGRFSPTRYFVEEVITGFDETDLHRSWVRAQATRSPQERNTRLENMCWRIWNLARQKKQLEGEQAQWMAKRRQEREKGRREAVADMSEDLSEGEKGDVVSDIPSHGESTKGRLPRISSVETMEAWVNQQRGKKLYIVLISLHGLIRGENMELGRDSDTGGQVKYVVELARALGSMPGVYRVDLLTRQVSSPEVDWSYGEPTEMLPPRSTEGLMTEMGESSGAYIIRIPFGPREKYIPKEQLWPYIPEFVDGALNHIIQMSKVLGEQIGNGYPVWPVAIHGHYADAGDSAALLSGALNVPMLFTGHSLGRDKLDQLLRQGRLSKDEINSTYKIMRRIEAEELTLDASEIVITSTRQEIDEQWRLYDGFDPILERKLRARIKRNVSCYGRFMPRMAVIPPGMEFHHIVPHEGDMDGETEGTEDGKAPDPPIWTEIMRFFSNPRKPMILALARPDPKKNLTTLVKAFGECRPLRELANLMLIMGNRDNIDEMSSTNSSVLLSILKMIDKYDLYGQVAYPKHHKQADVPDIYRLAAKTKGVFINPAFIEPFGLTLIEAAAYGLPMVATKNGGPVDIHRVLDNGLLVDPHDQQAIADALLKLVADKHLWAKCRANGLKNIHLFSWPEHCKTYLSRIASCKPRQPRWLRNDDDDDENSETDSPSDSLRDIHDISLNLRFSLDGEKNDNKENADNTLDPEVRKSKLENAVLSWSKGVLKSTPKAWSSDKGDQNSGPGKFPAIRRRRHIFVIAVDCDASSGLSESVRKIFEAVEKERAEGSIGFILASSFNISQVQSFLVSEGMKPTDFDAYICNSGGDLYYSSFHSEQNPFVVDLYYHSHIEYRWGGEGLRKTLVRWAASIIDKKGENEDHIVVEDEDNSADYCYTFKVRKLGTVPPAKELRKLMRIQALRCHAVYCQNGSRINVIPVLASRSQALRYLYLRWGMDLSKLVVFVGESGDTDYEGLIGGLRKAVIMKGLCASASSLIHGNSNYPLSDVLPFDSPNVVQSAEECSSTEIRSSLEKLGVLKG

SEQ ID NO: 25413 - protein, 510 aa, Streptomyces griseus
MSASTSRTLPPEIAESQSVMALIERGKADGQIAGDDVRRAFEADQIPATQWKNVLRSLNQILEEEGVTLMVSAAEPKRTRKSVAAKSPAKRTATTRTVAAKAAPVKKSAPAAAPTDEESEAPVKKAAAKKTTAKKTAKKATAKKTAAKKTAAKNVVDELLDDEAEEKPTTGKPGEEGAPEGTGGESQGFVLSDDDEDDAPAQQVAAAGATADPVKDYLKQIGKVPLLNAEQEVELAKRIEAGLFAEDKLANADKIAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 25414 - protein, 105 aa, Picea sitchensis
NLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPD

SEQ ID NO: 25415 - protein, 152 aa, Casuarina glauca
MALTEKQEALLKQSWEVLKQNIPAHSLRLFALILEAAPESKYVFSFLKDSNEIPENNPKLKAHAAVIFKTICESATELRQKGHAVWDNNTLKRLGSIHLKNKITDPHFEVMKGALLGTIKEAIKENWSDEMGCAWTEAYNQLVATIKAEMKE

SEQ ID NO: 25416 - protein, 145 aa, Casuarina glauca
EALLKQSWEVLKQNIPGHSLCLFALIIEAAPESKYVFSFLKDSNEIPENNPKLKAHAAVIFKTICESATELRQKGQAVWDNNTLKRLGSIHLKNKITDPHFEVMKGALLGTIKEAVKENWSDEMCCAWTEAYNQLVATIKAEMKE

SEQ ID NO: 25417 - protein, 370 aa, Arabidopsis thaliana
MNTGGGQYTDFPAVDTHGGQFISYDIFGSLFEITSKYRPPIIPIGRGAYGIVCSVLDTETNELVAMKKIANAFDNHMDAKRTLREIKLLRHLDHENIIAIRDVVPPPLRRQFSDVYISTELMDTDLHQIIRSNQSLSEEHCQYFLYQLLRGLKYIHSANIIHRDLKPSNLLLNANCDLKICDFGLARPTSENDFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNPMAIDLVDRMLTFDPNRRITVEQALNHQYLAKLHDPNDEPICQKPFSFEFEQQPLDEEQIKEMIYQEAIALNPTYG

SEQ ID NO: 25418 - protein, 368 aa, Arabidopsis thaliana
MAMLVEPPNGIKQQGKHYYSMWQTLFEIDTKYVPIKPIGRGAYGVVCSSINRETNERVAIKKIHNVFENRVDALRTLRELKLLRHVRHENVIALKDVMLPANRTSFKDVYLVYELMDTDLHQIIKSSQSLSDDHCKYFLFQLLRGLKYLHSANILHRDLKPGNLLVNANCDLKICDFGLARTSQGNEQFMTEYVVTRWYRAPELLLCCDNYGTSIDVWSVGCIFAEILGRKPIFPGTECLNQLKLIINVVGSQQESDIRFIDNPKARRFIKSLPYSRGTHLSNLYPQANPLAIDLLQRMLVFEPTKRISVTDALLHPYMAGLFEPGTNPPAHVPISLDIDENMEEPVIREMMWNEMLYYHPEAEILNA

SEQ ID NO: 25419 - protein, 283 aa, Lycopersicon esculentum
MPPYGTPVPYPALYPPAGVYAHPNIATPAPNSVPANPEADGKGPEGKDRNSSKKLKVCSGGKAGDNGKVTSGSGNDGATQSDESRSEGTSDTNDENDNNEFAANKKGSFDQMLRDGASAQNNPAKENHPTSIHGICTMPATNLNIGMDVWNASAAGPGAIKIQQNATGPVIGHEGRMNDQWIQEERELKRQKRKQSNRESARRSRLRKQAECEELQRRVEALSHENHSLKDELQRLSEECEKLTSENNLIKEELTLLCGPDVVSKLERNDNVTRIQSNVEEAS

SEQ ID NO: 25420 - protein, 321 aa, Antirrhinum majus
MVRSPCCDKVGVKKGPWTVDEDQKLLAYIEEHGHGSWRSLPLKAGLQRCGKSCRLRWANYLRPDIKRGPFSLQEEQTIIQLHALLGNRWSAIASHLPKRTDNEIKNYWNTHLKKRLTRMGIDPVTHKPHTHNILGHGQPKDVANLNHIAQWESARLQAERRLVRESRLAQNNNKIGTIQRRLTWPLCLDNEQSNHYHSALLNSTSAVGLNQDNSFTNYSARPDNNNIYDDYEVNNIMGMIEFNNNSNYFADSLRLPGFVEGITDISSSNIVLGAGVLPSNSDNVVGYFEENWSSVLNNVASSSSMDSPDVLVNASSSYKMY

SEQ ID NO: 25421 - protein, 670 aa, Plasmodium falciparum
MNIRNMFHMIRTIHMIHIIHINHMKSIKITNIFHQASKQKQICTFPVSQKTKKIYDELSDYNKHKKYSSSKMDKKKDSYYKEQSNKYKEKRKYDESSQDTYDKKRKRKRKKKKYDYEREEEKYNRYDERRDSSYYTSNYSEDSSKREGGKKEKEDLYISRKEFSGKKKSHKGEHNNNNHHTDQHIKNNYHTDQHIKNNYHTDQHNNNNHHTDQHNNNNHHTDQHNNNNHYTDQHNNNNHHTDQHNNTISDQINIFPEKNKRDNRINEEKYTIKEHLIYEDEQNISYESNKDSSSEENTILNEYSSDEEKNKIDCILNGCRNVKNYKKLNKISEGTYGAVYRAQNKRTKKIVALKKLKNFSSMHNEGFAMTSLREINILLQLQHDNILSIKEVVFGKHLNDIYLVMEYIEHELKMILDNKSPSFTISELKCLLKQLLSGINYLHRNWVMHRDLKPTNLYYSNKGILKICDFGMARKFGHVTNHNFTKNVVTLWYRAPELLLGEQCYTNKIDIWSAGCIFAEMILKKPLFVGENEIDQLFKILCLLGLPDKESYPEFYEYSFISKNKELFKKKKIKMNVNNIRSHFPNIANQFSGLYLSDNGLDLLQKMLHYNPQCRISAQEALNHPYFNEFPKPLDIKDMPIVPDSNKFIRSNKMANHFKLNSQNNIQFHS

SEQ ID NO: 25422 - protein, 359 aa, Xenopus laevis
MTLESIMACCLSEEAKEARRINDEIERQLRRDKRDARRELKLLLLGTGESGKSTFIKQMRIIHGSGYSDEDKRGFTKLVYQNIFTAMQAMIRAMETLKIPYKYEHNKGHALLVREVDVEKVASFENPYVDAIKYLWNDPGIQECYDRRREYQLSDSTKYYLNDVDRIATQGYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 25423 - protein, 405 aa, Gallus gallus
LENGLARTPPMGWLAWERFRCNVNCREDPRQCISEMLFMEMADRIAEDGWRELGYKYINIDDCWAAKQRDAEGRLVPDPERFPRGIKALADYVHARGLKLDIYGDLGRLTCGGYPGTTLDRVEQDAQTFAEWGVDMLKLDGCYSSGKEQAQGYPQMARALNSTGRPIVYSCSWPAYQGGLPPKVNYTLLGEICNLWRNYDDIQDSWDSVLSIVDWFFTNQDVLQPFAGPGHWNDPDMLIIGNFGLSYEQSRSQMALWTIMAAPLLMSTDLRTISPSAKKILQNRLMIQINQDPLGIQGRRIIKEGSHIEVFLRPLSQAASALVFFSRRTDMPFRYTTSLAKLGFPMGAAYEVQDVYSGKIISGLKTGDNFTVIINPSGVVMWYLCPKALLIQQQAPGGPSRLPLL

SEQ ID NO: 25424 - protein, 354 aa, Gallus gallus
MGCTLSAEDKAAVERSKMIDRNLREDGEKAAKEVKLLLLGAGESGKSTIVKQMKIIHEDGYSEEECKQYKVVVYSNTIQSIIAIIRAMGRLKIDFGEVARADDARQLFVLAGSAEEGVMTAELAGVIKRLWRDAGVQACFSRSREYQLNDSASYYLNDLDRISQPTYIPTQQDVLRTRVKTTGIVETHFTFKDLYFKMFDVGGQRSERKKWIHCFEGVTAIIFCVALSDYDLVLAEDEEMNRMHESMKLFDSICNNKWFTDTSIILFLNKKDLFEEKIKKSPLTICYPEYTGSNTYEEAAAYIQCQFEDLNRRKDTKEIYTHFTCATDTKNVQFVFDAVTDVIIKNNLKECGLY

SEQ ID NO: 25425 - protein, 248 aa, Homo sapiens [sequence omitted]

SEQ ID NO: 25426 - protein, 518 aa, Rattus norvegicus
METTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPEQQQKQSRKPSPRARDPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25427 - protein, 517 aa, basidiomycete C30
MAKFQSLLTFITLSLVASVYASIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGPAVPTADATLINGLGRSISTLNADLAVITVTKGKRYRFRLVSLSCDPNHTFSIDGHSLTVIEADSVNLKPQTVDSIQIFAAQRYSFVLNADQDVDNYWIRALPNSGTRNFDGGVNSAILRYDGAAPVEPTTTQTPSTQPLVESALTTLEGTAAPGNPTPGGVDLALNMAFGFAGGRFTINGASFTPPTVPVLLQILSGAQSAQDLLPSGSVYSLPANADIEISLPATSAAPGFPHPFHLHGHTFAVVRSAGSSTYNYANPVYRDVVSTGSPGDNVTIRFRTDNPGPWFLHCHIDFHLEAGFAVVMAEDIPDVAATNPVPQAWSDLCPTYDALSPDDQ

SEQ ID NO: 25428 - protein, 469 aa, Zygosaccharomyces cidri
MFPFFFALFFSSTDVLAASPSYNGLGLTPQMGWDNWNSFGCSVKEELLLGTAEKIVKLGLKDLGYNYIILDDCWSSGRSSNGSLLADDSKFPHGMKYVAEQLHNSQLKFGMYSSAGEYTCAGYAGSLGYEDMDAATFASWDVDYLKYDNCYNKGEFGTPEISYKRYKAMSDALNKTGRPIFYSLCNWGQDLTFYWGSAISNSWRMSGDVYPQFDRPDSRCPCSGDEYDCSYPGFHCSIMNILNKAAPMGQNAAPGGWNDLDMLEVGVGNMSDSEEVAHFSMWAIVKSPLIIGADIDDLKDSSLSVYSNPAVIAINQDVLGTPATRIWKYHVSDKDQYGEGEIQLWSGPLDNGDHVVALLNGGNNERSMNASWNDIFIDYLADSDELSNTWGLYDLWARRMSNATAASILSGNMTSAGLNYNVTQLNYTAGIARNDSRLFGDRVVELSKGESLTATVPGHGVALFRLRPE

SEQ ID NO: 25429 - protein, 403 aa, Saccharomyces cerevisiae
MAAIRDYKTALDLTKSLPRPDGLSVQELMDSKIRGGLAYNDFLILPGLVDFASSEVSLQTKLTRNITLNIPLVSSPMDTVTESEMATFMALLDGIGFIHHNCTPEDQADMVRRVKNYENGFINNPIVISPTTTVGEAKSMKEKYGFAGFPVTADGKRNAKLVGAITSRDIQFVEDNSLLVQDVMTKNPVTGAQGITLSEGNEILKKIKKGRLLVVDEKGNLVSMLSRTDLMKNQKYPLASKSANTKQLLWGASIGTMDADKERLRLLVKAGLDVVILDSSQGNSIFQLNMIKWIKETFPDLEIIAGNVVTKEQAANLIAAGADGLRIGMGTGSICITQKVMACGRPQGTAVYNVCEFANQFGVPCMADGGVQKHWSYYYQSFGSWFFYCYDGWYVGRYYRITR

SEQ ID NO: 25430 - protein, 157 aa, Saccharomyces cerevisiae
MVVFKNIGHIITKALALGSSTVMMGGMLAGTTESPGEYLYQDGKRLKAYRGMGSIDAMQKTGTKGNASTSRYFSESDSVLVAQGVSGAVVDKGSIKKFIPYLYNGLQHSCQDIGCRSLTLLKENVQSGKVRFEFRTASAQLEGGVNNLHSYEKRLHN

SEQ ID NO: 25431 - protein, 425 aa, Blastocladiella emersonii
MTLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 25432 - protein, 144 aa, Saccharomyces cerevisiae [sequence omitted]

SEQ ID NO: 25433 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 25434 - protein, 132 aa, Saccharomyces cerevisiae
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKTAKASQEL

SEQ ID NO: 25435 - protein, 103 aa, Saccharomyces cerevisiae
MSGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 25436 - protein, 348 aa, Saccharomyces cerevisiae; identical to SEQ ID NO: 976

SEQ ID NO: 25437 - protein, 99 aa, Saccharomyces cerevisiae
MAATKEAKQPKEPKKRTTRRKKDPNAPKRRLSAYMFFANENRDIVRSENPDVTFGQVGRILGERWKALTAEEKQPYESKAQADKKRYESEKELYNATRA

SEQ ID NO: 25438 - protein, 344 aa, Saccharomyces cerevisiae
MSSSVASTENIVENMLHPKTTEIYFSLNNGVRIPALGLGTANPHEKLAETKQAVKAAIKAGYRHIDTAWAYETEPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 25439 - protein, 298 aa, Saccharomyces cerevisiae
MSGELANYKRLEKVGEGTYGVVYKALDLRPGQGQRVVALKKIRLESEDEGVPSTAIREISLLKELKDDNIVRLYDIVHSDAHKLYLVFEFLDLDLKRYMEGIPKDQPLGADIVKKFMMQLCKGIAYCHSHRILHRDLKPQNLLINKDGNLKLGDFGLARAFGVPLRAYTHEIVTLWYRAPEVLLGGKQYSTGVDTWSIGCIFAEMCNRKPIFSGDSEIDQIFKIFRVLGTPNEAIWPDIVYLPDFKPSFPQWRRKDLSQVVPSLDPRGIDLLDKLLAYDPINRISARRAAIHPYFQES

SEQ ID NO: 25440 - protein, 386 aa, Saccharomyces cerevisiae; identical to SEQ ID NO: 1183

SEQ ID NO: 25441 - protein, 427 aa, Saccharomyces cerevisiae
MHHNSQSLSSGHIRSPEDENVAPIGNLKHRTGSLSHISSAHPRVALSDVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 25442 - protein, 815 aa, Saccharomyces cerevisiae
MSETLPRSDDLEATWNFIEPGINQILGNEKNQASTSKRVYKILSPTMYMEVYTAIYNYCVNKSRSSGHFSTDSRTGQSTILVGSEIYEKLKNYLKNYILNFKQSNSETFLQFYVKRWKRFTIGAIFLNHAFDYMNRYWVQKERSDGKRHIFDVNTLCLMTWKEVMFDPSKDVLINELLDQVTLGREGQIIQRSNISTAIKSLVALGIDPQDLKKLNLNVYIQVFEKPFLKKTQEYYTQYTNDYLEKHSVTEYIFEAHEIIKREEKAMTIYWDDHTKKPLSMALNKVLITDHIEKLENEFVVLLDARDIEKITSLYALIRRDFTLIPRMASVFENYVKKTGENEISSLLAMHKHNIMKNENANPKKLALMTAHSLSPKDYIKKLLEVHDIFSKIFNESFPDDIPLAKALDNACGAFININEFALPAGSPKSATSKTSEMLAKYSDILLKKATKPEVASDMSDEDIITIFKYLTDKDAFETHYRRLFAKRLIHGTSTSAEDEENIIQRLQAANSMEYTGKITKMFQDIRLSKILEDDFAVALKNEPDYSKAKYPDLQPFVLAENMWPFSYQEVEFKLPKELVPSHEKLKESYSQKHNGRILKWLWPLCRGELKADIGKPGRMPFNFTVTLFQMAILLLYNDADVLTLENIQEGTSLTIQHIAAAMVPFIKFKLIQQVPPGLDALVKPETQFKLSRPYKALKTNINFASGVKNDILQSLSGGGHDNHGNKLGNKRLTEDERIEKELNTERQIFLEACIVRIMKAKRNLPHTTLVNECIAQSHQRFNAKVSMVKRAIDSLIQKGYLQRGDDGESYAYLA

SEQ ID NO: 25443 - protein, 638 aa, Saccharomyces cerevisiae
MSRTNMDTRHAHSALLAAPQSATANSRSSNSSSESSSNKNNINVGVGDDSGNVSAVSIDDGPHFRDIFHYGHEENYKLASSGITNLNSSSHAHQTLSPISISNASTPESFPEHPLGLERETEPALEAEMEAEELPPHQSKYLLSSIKATKRLKDARPFLKPVDPIALNIPHYFNYVQTPMDLSLIETKLQGNVYHSVEQVTSDFKTMVDNCLNFNGPESSISSMAKRIQKYFEKKLSAMPPRVLPASALKKTSRNRKKNEDMDSPLVIRRSVSTTNDNIGESGNREGVSGGRPKRTIHPPKSKDLFDIYENSKPKSKTLQKKFRTCLKILKVLMSKKNSDINFPFLQPVDPIALNLPNYFDVVKNPMDLGTISNNLMNWKYKTIDQFVDDLNLVFYNCFQFNPEGNEVHSMGKKLKELFNFHWLENQDILNEIETDSDLEEDNYSSSYSSDDEYDDEDINENDITNPAIQYLEQKLKKMEVELQQLKRQELSKLSKERKRKHLGKTLLRRKAMKHSVDDLKKSITDKINELSDLEMNGMIRIIKNSLPADEILTSNEDEIEIDLDILDEATIARIYERYFEKKNNNNSKRKLSGNYSTAPTNKKKKTLKFLEKDEIINNNNYSDSEEDSSDSSDSDSD

SEQ ID NO: 25444 - protein, 165 aa, Saccharomyces cerevisiae
MKVKINEVHSVFAWSWHIPSTSDEDAANNDPIGNDEDEDVCGICRASYNGTCPSCKFPGDQCPLVIGLCHHNFHDHCIYRWLDTPTSKGLCPMCRQTFQLQKGLAINDAHVQKFVEIVSRRREEMIEEGVAEEFVDFDEPIRQNTDNPIGRQQVDTILDEDFLLR

SEQ ID NO: 25445 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 25446 - protein, 132 aa, Saccharomyces cerevisiae
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 25447 - protein, 421 aa, Saccharomyces cerevisiae
MSELLDSFETEFAKFYTDSNLEETNLQKCLDHTHEFKSQLKKLKAHLNKHIQESKPEVYNKLSDKEKQKFKRKRELIIEKLSKSQRQWDHSVKKQIKYVSQQSNRFNKSTLNKLKEFDIDSVYVNKLPKETMENVNEAIGYHILRYSIDNMPLGNKNEAFQYLKDVYGITNKESTEFIEMGQIVHDLKKGDTESCLKWCSNEMESLSSNHTALSSLKFDLYTLSAMQIVKHGNPVELYYQITQNAPLDCFRHREKELMQNVVPLLTKSLIGQPIEDIDSKVNKELKECTSLFIKEYCAAKHIFFDSPLFLIVLSGLISFQFFIKYKTIRELAHVDWTTKDELPFDVKLPDFLTHFHPIFICPVLKEETTTENPPYSLACHHIISKKALDRLSKNGTITFKCPYCPVNTSMSSTKKVRFVML

SEQ ID NO: 25448 - protein, 194 aa, Saccharomyces cerevisiae
MVTSNVVLVSGEGERFTVDKKIAERSLLLKNYLNDMHDSNLQNNSDSESDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 25449 - protein, 695 aa, Saccharomyces cerevisiae
MAGILSKTLSEVHPSLRTNGMGIGNTHRRISLGFLPPNKKNPLVRKFRARTRNIDQRSFRSLTDDFGSNVHEPNPYLGNIDEEPDLYYHDEEDGELSRTISLPSRVSETPELSPQDVDWILHEHERRYSSVCNSDNEEASQSNTPDRIQEYSGRELEYDEFMNRLQAQKQKLTRSAVTDAKGTSHHRRPSFVSVTSRGSVPTIYQEIDENDSEALAELAHSHVTFKSEARVLASYSFPLIFTFLLEQIFPMVCSLTVGHLGKNELAAVSLASMTSNITLAIFEGIATSLDTLCPQAYGSGRFYSVGVHLQRCIAFSLVIYIPFAVMWWYSEPLLSYIIPEKELINLTSRFLRVLILGAPAYIFFENLKRFLQAQGIFDAGIYVLTICAPLNVLVSYTLVWNKYIGVGFIGAAIAVVLNFWLMFFLLLFYALYIDGRKCWGGFSRKAFTHWNDLGHLAFSGIIMLEAEELSYELLTLFSAYYGVSYLAAQSAVSTMAALLYMIPFAIGISTSTRIANFIGAKRTDFAHISSQVGLSFSFIAGFINCCILVFGRNLIANIYSKDPEVIKLIAQVLPLVGIVQNFDSLNAVAGSCLRGQGMQSLGSIVNLMAYYLFGIPLALILSWFFDMKLYGLWIGIGSAMLLIGLVEAYYVLFPDWDKIMTYAEILKETEDDEVDSDEYLTDSDDPDENTALLGA

SEQ ID NO: 25450 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 25451 - protein, 633 aa, Saccharomyces cerevisiae
MLSKVLLNIAFKVLLTTAKRAVDPDDDDELLPSPDLPGSDDPIAGDPDVDLNPVTEEMFSSWALFIMLLLLISALWSSYYLTQKRIRAVHETVLSIFYGMVIGLIIRMSPGHYIQDTVTFNSSYFFNVLLPPIILNSGYELNQVNFFNNMLSILIFAIPGTFISAVVIGIILYIWTFLGLESIDISFADAMSVGATLSATDPVTILSIFNAYKVDPKLYTIIFGESLLNDAISIVMFETCQKFHGQPATFSSVFEGAGLFLMTFSVSLLIGVLIGILVALLLKHTHIRRYPQIESCLILLIAYESYFFSNGCHMSGIVSLLFCGITLKHYAYYNMSRRSQITIKYIFQLLARLSENFIFIYLGLELFTEVELVYKPLLIIVAAISICVARWCAVFPLSQFVNWIYRVKTIRSMSGITGENISVPDEIPYNYQMMTFWAGLRGAVGVALALGIQGEYKFTLLATVLVVVVLTVIIFGGTTAGMLEVLNIKTGCISEEDTSDDEFDIEAPRAINLLNGSSIQTDLGPYSDNNSPDISIDQFAVSSNKNLPNNISTTGGNTFGGLNETENTSPNPARSSMDKRNLRDKLGTIFNSDSQWFQNFDEQVLKPVFLDNVSPSLQDSATQSPADFSSQNH

SEQ ID NO: 25452 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 25453 - protein, 584 aa, Saccharomyces cerevisiae
MGIHIPYLTSKTSQSNVGDAVGNADSVEFNSEHDSPSKRGKITLESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 25454 - protein, 1142 aa, Saccharomyces cerevisiae
MAINGNSIPAIKDNTIGPWKLGETLGLGSTGKVQLARNGSTGQEAAVKVISKAVFNTGNVSGTSIVGSTTPDALPYGIEREIIIMKLLNHPNVLRLYDVWETNTDLYLVLEYAEKGELFNLLVERGPLPEHEAIRFFRQIIIGVSYCHALGIVHRDLKPENLLLDHKYNIKIADFGMAALETEGKLLETSCGSPHYAAPEIVSGIPYQGFASDVWSCGVILFALLTGRLPFDEEDGNIRTLLLKVQKGEFEMPSDDEISREAQDLIRKILTVDPERRIKTRDILKHPLLQKYPSIRDSKSIRGLPREDTYLTPLSESNSSIDATILQNLVILWHGRDPEGIKEKLREPGANAEKTLYALLYRFKCDTQKELIKQQQVKKRQSISSVSVSPSKKVSTTPQRRRNRESLISVTSSRKKPISFNKFTASSASSSNLTTPGSSKRLSKNFSSKKKLSTIVNQSSPTPASRNKRASVINVEKNQKRASIFSTTKKNKRSSRSIKRMSLIPSMKRESVTTKLMSTYAKLAEDDDWEYIEKETKRTSSNFATLIDEIFEYEKYEQIRKEKEELERKVREAKAREELERRRRKQEEKERARKLLEKEDLKRKQEELKKQIEIDISDLEQELSKHKEEKLDGNIRSISAPMENEEKNINHLEVDIDNILRRRNFSLQTRPVSRLDPGIMFSSPTEEVSPVEPKRTENERLTTEKKILETIRRSKFLGSSFNIDKELKLSKMEYPSIIAPQRLSEERVVSDSNDGYESLILPKDGNGVSQLKDSTATTAPVSDGRLRKISEIRVPQFTRKSRHFSESNKRLSVLSMYSTKESFTNLVDILKNGNLDVNNQQSQRIPTPRSADDSEFLFETVNEEAEYTGNSSNDERLYDVGDSTIKDKSALKLNFADRFNGSNEAKQTDNLHLPILPPLNGDNELRKQNSQEGDQAHPKIKSMIPESGSSSHTEKEEENEEKEEKKPEQHKQEEDQEKREKVVDDMEPPLNKSVQKIREKNAGSQAKDHSKDHLKEHKQDKNTAIGNGSFFRKFSKSSDKTMELYAKISAKQLFNGLEKLLRGWTQYGLKNIKSHPNNLTLTGKLSSDNIFSLRSTLFEVNIYPRGKMSVVQFKKVSGSFKAVKKLVNEVENVLNKEGVLQK

SEQ ID NO: 25455 - protein, 449 aa, Saccharomyces cerevisiae; identical to SEQ ID NO: 888

SEQ ID NO: 25456 - protein, 449 aa, Saccharomyces cerevisiae; identical to SEQ ID NO: 669

SEQ ID NO: 25457 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 25458 - protein, 2672 aa, Saccharomyces cerevisiae
MTAILNWEDISPVLEKGTRESHVSKRVPFLQDISQLVRQETLEKPQLSEIAFVLLNTFTIYEDNRSKSLVTSILLDILNLEPCLLENFIRFISDVVISNPATKAVADYLNLLDWINSFLIFVSHNSNLFEEYIPKLLVAHSYATFGVETILDNQEEGKKSQDKQNQHRKRIRYCIFQTTVKAFLKCLKDNDDSISFMKISIKTVLESYSKLKITSVGVVMIMGALTQAALQLLSRQPALHSVLKENSAEKYCEYLGKEVFLGKNPPSSFCLEIGLKPFLKEFVSQELFIKFFIPNIEKAVLRSPEVGFSILSELYAGVSPEKVNLLNAFASSKLINQYFSSFKSSKEVVRSVSLQSMIILLRKISNTDTTLEDLTKLIDEIFKNIKSNLNADYKSLISKILIEIPLTHYEVSEKICKGLSPYIGKEGNEAALTLMLNAFFVHYFSLGKPIEDLDKIISAGFADKKPALKKCWFAAFLNNSNAASEEVILNFIDGCLEFVKDSIIHYQTHGHACILASIEFTNKILALDNTELNDRVMQLIETLPENSSIGDAILTAALSTELSIENRIHAVNLLQELFYKKPEFIGFSVIDAIERRMRVQELIPQQNTSFKYVTSVLLAITSELPDKEASIKVLINALVIAQWNIFNIKNGWAGLVLRARLDPAEVVKEHASVIMEKILEITGSCEWIDTIYGACGLQAAAYAAFIQPNEFTPILCKTIEADLTADDFSRLSEEDFEIFAGEEGVLVVDVLEESMNKKLSNKNSKEYETLMWEQKIRKEQAKKNVKKLSKEEQELVNEQLAKESAVRSHVSEISTRLKRGIRLVSELSKAACLVQNGIATWFPLAVTKLLYLCSEPNISKLTEDVNNVFLQLSQNVSERLGNIRLFLGLATLRVHNANGISQDYLQEPLVELLTRVLFRIKFVSNQAAIDSISLTYILPLLINVLEKGKAIALKNADKPVVKAEFVEEDEEEEHLLLAMEIISVHAEAFEDPSIPRISIVEVLLSLLSLPSKAKIAKDCFNALCQSISVAPNQEDLDMILSNLLSPNQFVRSTILETLDNEFELEPFMKYSPEVFICRFDSDPSNREIADFIWEFNKFVVNDELLKSLFPLFNQDDSGLRLFAANAYAFGAVSLFTSEENSSKDYLNDLLNFYKEKAKPLEPILDQFGLVLVSASEQKDPWQGRSTVAITLKIMAKAFSAEDDTVVNIIKFLVDDGGLVDREPIVRQEMKEAGVELITLHGSQNSKDLIPIFEEALSSSTDSALKENVIILYGTLARHLQQSDARIHTIIERLLSTLDTPSADIQQAVSACIAPLVFQFKQKVGDYLGILMEKLLNPTVASSMRKGAAWGIAGLVKGYGISALSEFDIIRNLIEAAEDKKEPKRRESVGFCFQYLSESLGKFFEPYVIEILPNILKNLGDAVPEVRDATARATKAIMAHTTGYGVKKLIPVAVSNLDEIAWRTKRGSVQLLGNMAYLDPTQLSASLSTIVPEIVGVLNDSHKEVRKAADESLKRFGEVIRNPEIQKLVPVLLQAIGDPTKYTEEALDSLIQTQFVHYIDGPSLALIIHIIHRGMHDRSANIKRKACKIVGNMAILVDTKDLIPYLQQLIDEVEIAMVDPVPNTRATAARALGALVERLGEEQFPDLIPRLLDTLSDESKSGDRLGSAQALAEVISGLGLTKLDEMLPTILAGVTNFRAYIREGFMPLLLFLPVCFGSQFAPYINQIIQPILSGLADNDENIRDTALKAGKLIVKNYATKAVDLLLPELERGMFDENDRIRLSSVQLTGELLFQVTGISSRNEFSEEDGDHNGEFSGKLVDVLGQDRRDRILAALFVCRNDTSGIVRATTVDIWKALVPNTPRAVKEILPTLTGMIVTHLASSSNVLRNIAAQTLGDLVRRVGGNALSQLLPSLEESLIETSNSDSRQGVCIALYELIESASTETISQFQSTIVNIIRTALIDESATVREAAALSFDVFQDVVGKTAVDEVLPYLLHMLESSDNSDFALLGLQEIMSKKSDVIFPILIPTLLAPPIDAFRASALGSLAEVAGSALYKRLSIIINALVDAIIGTSEDESTKGALELALDRVFLSVNDDEGLHPLLQQIMSLLKSDNIEKRIAVLERLPNFFDKTVLDFDVYIPNFVSHAILSLDDEDQRVVNGNFNALSTLLKKVDKPTLEKLVKPAKQSLALTGRQGQDVAAFKLPRGPNCVLPIFLHGLMYGSNDEREESALAIADVVSKTPAANLKPFVSVITGPLIRVVGERFSSDIKAAILFALNVLFIKIPMFLRPFIPQLQRTFVKSLSDATNETLRLRAAKALGALIEHQPRVDPLVIELVTGAKQATDEGVKTAMLKALLEVIMKAGSKLNENSKTNIVNLVEEEMLGSNDKLAVAYAKLIGSLSEILSNDEAHKILQDKVLNADLDGETGKFAILTLNSFLKDAPTHIFNTGLIDEFVSYILNAIRSPDVYFGENGTIAAGKLLLLEGEKRSPFVKKDAAEPFKIGDENINLLINELSKAVLQPASNSTDVRRLALVVIRTLARFKFDECIKQYFDVVGPSVFSCLRDPVIPIKLAAEKAYLALFKLVEEDDMHTFNEWFAKISDRGNSIETVTGTTIQLRSVGDYTKRVGKRLANVERERIAAGGDAETMFSDRFEDEREIWAVGGVELTTDI

SEQ ID NO: 25459 - protein, 725 aa, Saccharomyces cerevisiae
MPQSTPSQEVQRVPWDNKPALKQITLRATIAGIAIGSLVLTSNFQFGLQTGWVSMMSLPSALLACAFFKNIWPLIFPNDRPFSDVENVYVQSMAVAVGTGPLAFGFVGVIPAIEKFLTNDESGGLREQGQSFTFRELLIWSTALAFFGIFFAVPLRKQVIVREKLPFPSGSATATLISVLNGTEILQEVSKSELLEMRQRRLNECPEVLQPNRDPEEADYLMNSSHSELGDYTATSQDGSSILSTGSENYRANIIILLKTFVVSSLYTMVSYFVPVIRSIPVFGKYLSNNYLWNFQPSPAYIGQGIIMGLPTVSYMLIGCFLGWGVLAPLARYKRWVPPDADVHDWEEGVQGWILWSSLSIMVADSVVAFIVVTVKSIVKFILIDDKAALLNNIIDDTFQSMLLEEERAINSSRRNTYVDGRQDTVRLVSRDNEIEVDSKHLVRYTTVISGCLVSSIICIVSIIYLFGIQVIPLYAIITALILALFLSILGIRALGETDLNPVSGIGKISQLIFAFIIPRDRPGSVLMNVVSGGIAEASAQQAGDLMQDLKTGHLLGASPRAQFCAQLIGACWSIILSSFMYLCYNKVYSIPSEQFRIPTAVVWIDCARLVTGKGLPDKALECSMILGVIFAVLSLIRNTYRDYGYGWILYIPSGVAVGVGIFNSPSFTIARFIGGWASHFWLKNHRGDLNAKTKMIVFSSGLVLGEGIFSVINMLFICLNVPHY

SEQ ID NO: 25460 - protein, 328 aa, Saccharomyces cerevisiae
MTEILPHVNDEVLPAEYELNQPEPEHCPGPESDMAGKSDACGGCANKEICESLPKGPDPDIPLITDNLSGIEHKILVLSGKGGVGKSTFAAMLSWALSADEDLQVGAMDLDICGPSLPHMLGCIKETVHESNSGWTPVYVTDNLATMSIQYMLPEDDSAIIWRGSKKNLLIKKFLKDVDWDKLDYLVIDTPPGTSDEHISINKYMRESGIDGALVVTTPQEVALLDVRKEIDFCKKAGINILGLVENMSGFVCPNCKGESQIFKATTGGGEALCKELGIKFLGSVPLDPRIGKSCDMGESFLDNYPDSPASSAVLNVVEALRDAVGDV

SEQ ID NO: 25461 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDEEEEETDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 25462 - protein, 309 aa, Saccharomyces cerevisiae
MDSKEVLVHVKNLEKNKSNDAAVLEILHVLDKEFVPTEKLLRETKVGVEVNKFKKSTNVEISKLVKKMISSWKDAINKNKRSRQAQQHHQDHAPGNAEDKTTVGESVNGVQQPASSQSDAMKQDKYVSTKPRNSKNDGVDTAIYHHKLRDQVLKALYDVLAKESEHPPQSILHTAKAIESEMNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 25463 - protein, 278 aa, Saccharomyces cerevisiae; identical to SEQ ID NO: 969

SEQ ID NO: 25464 - protein, 216 aa, Saccharomyces cerevisiae
MLSHYIFLAFVLLPFRVSAFYFYGYGGDRKCFLKELSKDTLLKGSYNLEVYDDKLADYALPSYNDYGIVIDVEEVFDNNHRVVHQQGSPSGDFSFLALESGEYKICLQSRVNNWVGKTKTKLEIEFEVGFEAMLDMQRKETLESLHGKVSILNSKIVDIRREQQLMREREESFRDISESVNSRAMWWTVTQVTLLIIICVWQMKSLRSFFVKQKVL

SEQ ID NO: 25465 - protein, 368 aa, Saccharomyces cerevisiae
MARTITFDIPSQYKLVDLIGEGAYGTVCSAIHKPSGIKVAIKKIQPFSKKLFVTRTIREIKLLRYFHEHENIISILDKVRPVSIDKLNAVYLVEELMETDLQKVINNQNSGFSTLSDDHVQYFTYQILRALKSIHSAQVIHRDIKPSNLLLNSNCDLKVCDFGLARCLASSSDSRETLVGFMTEYVATRWYRAPEIMLTFQEYTTAMDIWSCGCILAEMVSGKPLFPGRDYHHQLWLILEVLGTPSFEDFNQIKSKRAKEYIANLPMRPPLPWETVWSKTDLNPDMIDLLDKMLQFNPDKRISAAEALRHPYLAMYHDPSDEPEYPPLNLDDEFWKLDNKIMRPEEEEEVPIEMLKDMLYDELMKTME

SEQ ID NO: 25466 - protein, 605 aa, Saccharomyces cerevisiae; identical to SEQ ID NO: 651

SEQ ID NO: 25467 - protein, 471 aa, Saccharomyces cerevisiae
MSRSLLVENSRTINSNEEKGVNESQYILQKRNVPRTILGNVTNNANILQEISMNRKIGMKNFSKLNNFFPLKDDVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLAINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 25468 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 25469 - protein, 399 aa, Saccharomyces cerevisiae [sequence omitted]

SEQ ID NO: 25470 - protein, 882 aa, Saccharomyces cerevisiae
MVPFKLTNKVPTDTGPSLISAQSVPRPIVFMDNRNNTRIVTPTLPPNQHRGISGASTALPWSPESKNTGKYIWNRVKLKNSPFPRYRHSSSFIVTNDNRIFVTGGLHDQSVYGDVWQIAANADGTSFTSKRIDIDQNTPPPRVGHASTICGNAYVVFGGDTHKLNKNGLLDDDLYLFNINSYKWTIPQPIGRRPLGRYGHKISIIASNPMQTKLYLFGGQVDETYFNDLVVFDLSSFRRPNSHWEFLEPVGDLPPPLTNHTMVAYDNKLWVFGGETPKTISNDTYRYDPAQSEWSKVKTTGEKPPPIQEHASVVYKHLMCVLGGKDTHNAYSNDVYFLNLLSLKWYKLPRMKEGIPQERSGHSLTLMKNEKLLIMGGDKTDYASPNIHDLQTSETDQGEGTLLYTLDLSSLNELCPGIMCESLHAGESFSNSLSGGFTPSKSTESENQEIINILTPRLPDSKVLSYNDIDEGAGSYSSALDDKAFERKSDREEKKPQSSKVDSSINKESPGTGIKVSKKNFPVLRGLTVDSEEYGSSSYKDTSCQKGIPKNLFDDLNLNLQTLRLEAQQKELETARHISQLEKEVQRLMVIKEASKDSNFQTARLKNLEIQKTFLESRINDLKNLLMVKLSQASKLCDQITIQNNGLKTCSEHVTIKRDIIDLENKCDVLKRQNEILVNNMQKITPELHTYLNESSCYLGKLLKSYPTSARPPSSEKDNQIYEKDSLNKIEKVINEMHETVRAKEKLHLETQKLNDERDSLRANLLDNNNKLDALRKLSDGSSKSMDLTKKAIHLSQSELEKYRKNNDDLQKEIDRIKTEQAEQDDKQEQRGAITHGNFDAFHRMKINNLKAELYMSKENRDSLKDELLALKKKLYTLEQKK

SEQ ID NO: 25471 - protein, 146 aa, Saccharomyces cerevisiae
MSASAFNFAFRRFWNSETGPKTVHFWAPTLKWGLVFAGLNDIKRPVEKVSGAQNLSLLATALIWTRWSFVIKPKNYLLASVNFFLGCTAGYHLTRIANFRIRNGDSFKQVIHYIIKGETPAAVAAKQTASTSMNKGVIGTNPPITH

SEQ ID NO: 25472 - protein, 423 aa, Rattus norvegicus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMGELVKGCVIFQGTDHWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSDAAVSSKATPSQSSSINDISSMSTEHTLASDTDSSLDASTGPLEGCR

SEQ ID NO: 25473 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKIKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 25474 - protein, 411 aa, Rattus norvegicus
MSRSKRDNNFYSVEIADSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCLKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPVSSPSVNDSMSMSTDPTLASD

SEQ ID NO: 25475 - protein, 493 aa, Saccharomyces cerevisiae
MTVFSGVNKIEFEGTFEGIGKDVVMSQMIRALQKHFPSIRDKNYEFSLFLHIFQRYVLENTSITHDLVCDKIRLPIIDEVVELDDIKNYGLLEGKLLSKLAILKLTGKANPIIGKESPLFEVKNGMSSLDVIVRQTQNLNVRYNSDVPLIFMTSLETESQVSNFLEEHYSSSKVRWKTVVQSSFPQIDKDRLLPIDLQINSHENDFWYPCGTGNLTDTLYFSGELDKLIAQGKEILFVSNVDNLGATGDLNILNFIINEKIEYLVEVVERTANVSNTGVLATYKGKLRSVYYNCLSNESASTCRIVNTNNIWIDLKKLKVLIESNSLNLPIHSSESKITHKNEEIECLQFKTQLVDCIAFFPNSRVLKVSRDRFLPLRTCKDLFLLKSTLYDLDSNGTFNLYPLKFGLLPSIDLGDEFATYETFKIGVPDIPNILELEHLTVMGNVFFGRNITLKGTVIIICDENDVITVPDGSILENVTIWHKSQLEDMNGY

SEQ ID NO: 25476 - protein, 585 aa, Saccharomyces cerevisiae
MDQFEYIITLEFGNQNQVESAYQIFKSIPKKLKAKSIGEESIKSNNQDWQDWRVCDLEIDMITDFKNQTSKEEESDLITSQYLGHGIIRLFKLSNANNTLNEKEILTIPGDDTMICILFVPTYFTVHDLLHFYIGDDIVNKQVSNFRILRNQQKGMGFNFTVLIKFRNALDAKNFKEEFNGKSFSRMDPETCHVISVKEIVFQKKLFQRPAANEDFPYLLTDPFTVKKKKELVKVELPTCPVCLERMDSETTGLVTIPCQHTFHCQCLNKWKNSRCPVCRHSSLRLSRESLLKQAGDSAHCATCGSTDNLWICLICGNVGCGRYNSKHAIKHYEETLHCFAMDIRTQRVWDYAGDNYVHRLVQNEVDGKLVEVGGSGDDDNNDIGNSDELQNVVYGNRSKNGEKSNSNKKDGELAANFLRHREYHLEYVQVLISQLESQREYYELKLQEKDQTASDSSNVESLKKSMEDLKLQFQVTQKEWQKREMAQKSKLEEDMLVIEGLQANLDHLSKKQEQLERENKALEESKQDLEEQVKDLMFYLDSQEKFKDADESVKEGTILIQQPHGAAQASKSKKKRNKNKKAGK

SEQ ID NO: 25477 - protein, 472 aa, Saccharomyces cerevisiae
MGCTVSTQTIGDESDPFLQNKRANDVIEQSLQLEKQRDKNEIKLLLLGAGESGKSTVLKQLKLLHQGGFSHQERLQYAQVIWADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDADRNNSSRINLQDICKDLNQEGDDQMFVRKTSREIQGQNRRNLIHEDIAKAIKQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKIGII

SEQ ID NO: 25478 - protein, 484 aa, Saccharomyces cerevisiae
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 25479 - protein, 581 aa, Saccharomyces cerevisiae
MSKQFSHTTNDRRSSIIYSTSVGKAGLFTPADYIPQESEENLIEGEEQEGSEEEPSYTGNDDETEREGEYHSLLDANNSRTLQQEAWQQGYDSHDRKRLLDEERDLLIDNKLLSQHGNGGGDIESHGHGQAIGPDEEERPAEIANTWESAIESGQKISTTFKRETQVITMNALPLIFTFILQNSLSLASIFSVSHLGTKELGGVTLGSMTANITGLAAIQGLCTCLDTLCAQAYGAKNYHLVGVLVQRCAVITILAFLPMMYVWFVWSEKILALMIPERELCALAANYLRVTAFGVPGFILFECGKRFLQCQGIFHASTIVLFVCAPLNALMNYLLVWNDKIGIGYLGAPLSVVINYWLMTLGLLIYAMTTKHKERPLKCWNGIIPKEQAFKNWRKMINLAIPGVVMVEAEFLGFEVLTIFASHLGTDALGAQSIVATIASLAYQVPFSISVSTSTRVANFIGASLYDSCMITCRVSLLLSFVCSSMNMFVICRYKEQIASLFSTESAVVKMVVDTLPLLAFMQLFDAFNASTAGCLRGQGRQKNRWVHQPSRILLPRCAHGICVSIPVSSGCRRLMVGYN

SEQ ID NO: 25480 - protein, 1115 aa, Saccharomyces cerevisiae; identical to SEQ ID NO: 1053

SEQ ID NO: 25481 - protein, 327 aa, Saccharomyces cerevisiae
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 25482 - protein, 1080 aa, Saccharomyces cerevisiae
MSNYYRRAHASSGSYRQPQEQPQYSRSGHYQYSNGHSHQQYSSQYNQRRRYNHNDGTRRRYNDDRPHSSNNASTRQYYATNNSQSGPYVNKKSDISSRRGMSQSRYSNSNVHNTLASSSGSLPTESALLLQQRPPSVLRYNTDNLKSKFHYFDPIKGEFFNKDKMLSWKATDKEFSETGYYVVKELQDGQFKFKIKHRHPEIKASDPRNENGIMTSGKVATHRKCRNSLILLPRISYDRYSLGPPPSCEIVVYPAQDSTTTNIQDISIKNYFKKYGEISHFEAFNDPNSALPLHVYLIKYASSDGKINDAAKAAFSAVRKHESSGCFIMGFKFEVILNKHSILNNIISKFVEINVKKLQKLQENLKKAKEKEAENEKAKELQGKDITLPKEPKVDTLSHSSGSEKRIPYDLLGVVNNRPVLHVSKIFVAKHRFCVEDFKYKLRGYRCAKFIDHPTGIYIIFNDIAHAQTCSNAESGNLTIMSRSRRIPILIKFHLILPRFQNRTRFNKSSSSSNSTNVPIKYESKEEFIEATAKQILKDLEKTLHVDIKKRLIGPTVFDALDHANFPELLAKRELKEKEKRQQIASKIAEDELKRKEEAKRDFDLFGLYGGYAKSNKRNLKRHNSLALDHTSLKRKKLSNGIKPMAHLLNEETDSKETTPLNDEGITRVSKEHDEEDENMTSSSSEEEEEEAPDKKFKSESEPTTPESDHLHGIKPLVPDQNGSSDVLDASSMYKPTATEIPEPVYPPEEYDLKYSQTLSSMDLQNAIKDEEDMLILKQLLSTYTPTVTPETSAALEYKIWQSRRKVLEEEKASDWQIELNGTLFDSELQPGSSFKAEGFRKIADKLKINYLPHRRRVHQPLNTVNIHNERNEYTPELCQREESSNKEPSDSVPQEVSSSRDNRASNRRFQQDIEAQKAAIGTESELLSLNQLNKRKKPVMFARSAIHNWGLYALDSIAAKEMIIEYVGERIRQPVAEMREKRYLKNGIGSSYLFRVDENTVIDATKKGGIARFINHCCDPNCTAKIIKVGGRRRIVIYALRDIAASEELTYDYKFEREKDDEERLPCLCGAPNCKGFLN

SEQ ID NO: 25483 - protein, 1164 aa, Saccharomyces cerevisiae
MAGFSFAKKFTHKKHGKTPSDASISDQSREASLSTPPNEKFFTKQETPQKGRQFSQGYHSNVNKTSSPPMFARKQVSESRIQPSAVPPQQRNVSGPSTTLHKQLSKQREYTVWNRIKLQNSPFPRYRHVASAYVTDKNQIYVIGGLHDQSVYGDTWILTAFDNATRFSTTTIDISEATPPPRVGHAAVLCGNAFVVFGGDTHKVNKEGLMDDDIYLLNINSYKWTVPAPVGPRPLGRYGHKISIIATTQMKTKLYVFGGQFDDTYFNDLAVYDLSSFRRPDSHWEFLKPRTFTPPPITNFTMISYDSKLWVFGGDTLQGLVNDVFMYDPAINDWFIIDTTGEKPPPVQEHATVVYNDLMCVVGGKDEHDAYLNSVYFLNLKSRKWFKLPVFTAGIPQGRSGHSLTLLKNDKILIMGGDKFDYARVEEYDLHTSDIDMQRGTIVYTLDLARIKDLCPGVMDVPTDTPTPRNGNLDLATPVTPTSHQTKNMNVPISAAPLASAPSPAPKDFSDADRLNREVHNRNVSTEHQNQSHPVNSESHLIAEPNILTPYVPSESSQTPVMKITSNKPFDTPTIQKEPDLSETMDPTVGNQRIPSSIYGDNLTPANQIKNNSPILETLPSNEIKTPQNGNIEEIKHLPDADEKIDSTTTFDQEINGDKLGTSSMSKVEEDGNVADEDDEIGVAQMASSPSKDQFKIKHYNESSELSQNNTEIDKLSEPVDITIKKSDTAGHDSANHVIDASDEKNVSPMGDVPTDTKNEEASVPINRDATTEVVDRALFEKLRSELQSLKELTHEKALEAGAHIKELETELWQLKSQKNSGTTKEIDELDSVRLQSKCEILEADNHSLEDKVNELEELVNSKFLDIENLNEVIQFQNEKIKSLELEPNYKEKLEELQIEHENLSRENERLKNESKQHNEDIINNVANYSSQLGSLISHWKENRANSSFLESSSSLISVSDENGEKTVGEPYGDQSRHHRVVINKLTNRLDDLLERSQELTISKEKLSSEYHALKMEHSSLSQDVLVKENEIKKIQNDYKESISSMDSASKALMVSQRELEKYKSLNKKLIDELDELKFKNGVCSENFENGLRSTEESSNNVKNSNSIRENQFNIKINDLKAELFITNQERDDLKSEVLELKKRLLNLENNTKQVNEDADSDLL

SEQ ID NO: 25484 - protein, 129 aa, Saccharomyces cerevisiae
MSTSSVRFAFRRFWQSETGPKTVHFWAPTLKWGLVFAGFSDMKRPVEKISGAQNLSLLSTALIWTRWSFVIKPRNILLASVNSFLCLTAGYQLGRIANYRIRNGDSISQLCSYILSGADESKKEITTGR

SEQ ID NO: 25485 - protein, 437 aa, Saccharomyces cerevisiae
MAVSKVYARSVYDSRGNPTVEVELTTEKGVFRSIVPSGASTGVHEALEMRDEDKSKWMGKGVMNAVNNVNNVIAAAFVKANLDVKDQKAVDDFLLSLDGTANKSKLGANAILGVSMAAARAAAAEKNVPLYQHLADLSKSKTSPYVLPVPFLNVLNGGSHAGGALALQEFMIAPTGAKTFAEAMRIGSEVYHNLKSLTKKRYGASAGNVGDEGGVAPNIQTAEEALDLIVDAIKAAGHDGKVKIGLDCASSEFFKDGKYDLDFKNPESDKSKWLTGVELADMYHSLMKRYPIVSIEDPFAEDDWEAWSHFFKTAGIQIVADDLTVTNPARIATAIEKKAADALLLKVNQIGTLSESIKAAQDSFAANWGVMVSHRSGETEDTFIADLVVGLRTGQIKTGAPARSERLAKLNQLLRIEEELGDKAVYAGENFHHGDKL

SEQ ID NO: 25486 - protein, 622 aa, Saccharomyces cerevisiae
MSFSTINSNVNKTTGDSNNNTTENSSTADLLGMDLLQSGPRLMNTMQPNNSSDMLHINNKTNNVQQPAGNTNISSANAGAKAPANEFVRKLFRILENNEYPDIVTWTENGKSFVVLDTGKFTTHILPNHFKHSNFASFVRQLNKYDFHKVKRSPEERQRCKYGEQSWEFQHPEFRVHYGKGLDNIKRKIPAQRKVLLDESQKALLHFNSEGTNPNNPSGSLLNESTTELLLSNTVSKDAFGNLRRRVDKLQKELDMSKMESYATKVELQKLNSKYNTVIESLITFKTINENLLNNFNTLCSTLANNGIEVPIFGDNGNRNPTGNTNPATTTAIQSNNNTNNASPATSTVSLQLPNLPDQNSLTPNAQNNTVTLRKGFHVLLVEDDAVSIQLCSKFLRKYGCTVQVVSDGLSAISTLEKYRYDLVLMDIVMPNLDGATATSIVRSFDNETPIIAMTGNIMNQDLITYLQHGMNDILAKPFTRDDLHSILIRYLKDRIPLCEQQLPPRNSSPQTHSNTNTANSNPNTINEQSLAMLPQDNPSTTTPVTPGASISSAQHVQQGQQEQQHQIFHAQQQQQHHNAIANARSDVAIPNLEHEINTVPHSSMGSTPQLPQSTLQENQLS

SEQ ID NO: 25487 - protein, 523 aa, Saccharomyces cerevisiae; identical to SEQ ID NO: 1151

SEQ ID NO: 25488 - protein, 1220 aa, Saccharomyces cerevisiae
MRFGLPSKLELTPPFRIGIRTQLTALVSIVALGSLIILAVTTGVYFTSNYKNLRSDRLYIAAQLKSSQIDQTLNYLYYQAYYLASRDALQSSLTSYVAGNKSADNWVDSLSVIQKFLSSSNLFYVAKVYDSSFNAVLNATNNGTGDLIPEDVLDSLFPLSTDTPLPSSLETIGILTDPVLNSTDYLMSMSLPIFANPSIILTDSRVYGYITIIMSAEGLKSVFNDTTALEHSTIAIISAVYNSQGKASGYHFVFPPYGSRSDLPQKVFSIKNDTFISSAFRNGKGGSLKQTNILSTRNTALGYSPCSFNLVNWVAIVSQPESVFLSPATKLAKIITGTVIAIGVFVILLTLPLAHWAVQPIVRLQKATELITEGRGLRPSTPRTISRASSFKRGFSSGFAVPSSLLQFNTAEAGSTTSVSGHGGSGHGSGAAFSANSSMKSAINLGNEKMSPPEEENKIPNNHTDAKISMDGSLNHDLLGPHSLRHNDTDRSSNRSHILTTSANLTEARLPDYRRLFSDELSDLTETFNTMTDALDQHYALLEERVRARTKQLEAAKIEAEAANEAKTVFIANISHELRTPLNGILGMTAISMEETDVNKIRNSLKLIFRSGELLLHILTELLTFSKNVLQRTKLEKRDFCITDVALQIKSIFGKVAKDQRVRLSISLFPNLIRTMVLWGDSNRIIQIVMNLVSNALKFTPVDGTVDVRMKLLGEYDKELSEKKQYKEVYIKKGTEVTENLETTDKYDLPTLSNHRKSVDLESSATSLGSNRDTSTIQEEITKRNTVANESIYKKVNDREKASNDDVSSIVSTTTSSYDNAIFNSQFNKAPGSDDEEGGNLGRPIENPKTWVISIEVEDTGPGIDPSLQESVFHPFVQGDQTLSRQYGGTGLGLSICRQLANMMHGTMKLESKVGVGSKFTFTLPLNQTKEISFADMEFPFEDEFNPESRKNRRVKFSVAKSIKSRQSTSSVATPATNRSSLTNDVLPEVRSKGKHETKDVGNPNMGREEKNDNGGLEQLQEKNIKPSICLTGAEVNEQNSLSSKHRSRHEGLGSVNLDRPFLQSTGTATSSRNIPTVKDDDKNETSVKILVVEDNHVNQEVIKRMLNLEGIENIELACDGQEAFDKVKELTSKGENYNMIFMDVQMPKVDGLLSTKMIRRDLGYTSPIVALTAFADDSNIKECLESGMNGFLSKPIKRPKLKTILTEFCAAYQGKKNNK

SEQ ID NO: 25489 - protein, 372 aa, Saccharomyces cerevisiae; identical to SEQ ID NO: 965

SEQ ID NO: 25490 - protein, 293 aa, Saccharomyces cerevisiae
MEEQEIGVPAASLAGIKHIILILSGKGGVGKSSVTTQTALTLCSMGFKVGVLDIDLTGPSLPRMFGLENESIYQGPEGWQPVKVETNSTGSLSVISLGFLLGDRGNSVIWRGPKKTSMIKQFISDVAWGELDYLLIDTPPGTSDEHISIAEELRYSKPDGGIVVTTPQSVATADVKKEINFCKKVDLKILGIIENMSGFVCPHCAECTNIFSSGGGKRLSEQFSVPYLGNVPIDPKFVEMIENQVSSKKTLVEMYRESSLCPIFEEIMKKLRKQDTTTPVVDKHEQPQIESPK

SEQ ID NO: 25491 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 25492 - protein, 250 aa, Saccharomyces cerevisiae; identical to SEQ ID NO: 1061

SEQ ID NO: 25493 - protein, 2470 aa, Saccharomyces cerevisiae
MEPHEEQIWKSKLLKAANNDMDMDRNVPLAPNLNVNMNMKMNASRNGDEFGLTSSRFDGVVIGSNGDVNFKPILEKIFRELTSDYKEERKLASISLFDLLVSLEHELSIEEFQAVSNDINNKILELVHTKKTSTRVGAVLSIDTLISFYAYTERLPNETSRLAGYLRGLIPSNDVEVMRLAAKTLGKLAVPGGTYTSDFVEFEIKSCLEWLTASTEKNSFSSSKPDHAKHAALLIITALAENCPYLLYQYLNSILDNIWRALRDPHLVIRIDASITLAKCLSTLRNRDPQLTSQWVQRLATSCEYGFQVNTLECIHASLLVYKEILFLKDPFLNQVFDQMCLNCIAYENHKAKMIREKIYQIVPLLASFNPQLFAGKYLHQIMDNYLEILTNAPANKIPHLKDDKPQILISIGDIAYEVGPDIAPYVKQILDYIEHDLQTKFKFRKKFENEIFYCIGRLAVPLGPVLGKLLNRNILDLMFKCPLSDYMQETFQILTERIPSLGPKINDELLNLVCSTLSGTPFIQPGSPMEIPSFSRERAREWRNKNILQKTGESNDDNNDIKIIIQAFRMLKNIKSRFSLVEFVRIVALSYIEHTDPRVRKLAALTSCEIYVKDNICKQTSLHSLNTVSEVLSKLLAITIADPLQDIRLEVLKNLNPCFDPQLAQPDNLRLLFTALHDESFNIQSVAMELVGRLSSVNPAYVIPSIRKILLELLTKLKFSTSSREKEETASLLCTLIRSSKDVAKPYIEPLLNVLLPKFQDTSSTVASTALRTIGELSVVGGEDMKIYLKDLFPLIIKTFQDQSNSFKREAALKALGQLAASSGYVIDPLLDYPELLGILVNILKTENSQNIRRQTVTLIGILGAIDPYRQKEREVTSTTDISTEQNAPPIDIALLMQGMSPSNDEYYTTVVIHCLLKILKDPSLSSYHTAVIQAIMHIFQTLGLKCVSFLDQIIPTILDVMRTCSQSLLEFYFQQLCSLIIIVRQHIRPHVDSIFQAIKDFSSVAKLQITLVSVIEAISKALEGEFKRLVPLTLTLFLVILENDKSSDKVLSRRVLRLLESFGPNLEGYSHLITPKIVQMAEFTSGNLQRSAIITIGKLAKDVDLFEMSSRIVHSLLRVLSSTTSDELSKVIMNTLSLLLIQMGTSFAIFIPVINEVLMKKHIQHTIYDDLTNRILNNDVLPTKILEANTTDYKPAEQMEAADAGVAKLPINQSVLKSAWNSSQQRTKEDWQEWSKRLSIQLLKESPSHALRACSNLASMYYPLAKELFNTAFACVWTELYSQYQEDLIGSLCIALSSPLNPPEIHQTLLNLVEFMEHDDKALPIPTQSLGEYAERCHAYAKALHYKEIKFIKEPENSTIESLISINNQLNQTDAAIGILKHAQQHHSLQLKETWFEKLERWEDALHAYNEREKAGDTSVSVTLGKMRSLHALGEWEQLSQLAARKWKVSKLQTKKLIAPLAAGAAWGLGEWDMLEQYISVMKPKSPDKEFFDAILYLHKNDYDNASKHILNARDLLVTEISALINESYNRAYSVIVRTQIITEFEEIIKYKQLPPNSEKKLHYQNLWTKRLLGCQKNVDLWQRVLRVRSLVIKPKQDLQIWIKFANLCRKSGRMRLANKALNMLLEGGNDPSLPNTFKAPPPVVYAQLKYIWATGAYKEALNHLIGFTSRLAHDLGLDPNNMIAQSVKLSSASTAPYVEEYTKLLARCFLKQGEWRIATQPNWRNTNPDAILGSYLLATHFDKNWYKAWHNWALANFEVISMVQEETKLNGGKNDDDDDTAVNNDNVRIDGSILGSGSLTINGNRYPLELIQRHVVPAIKGFFHSISLLETSCLQDTLRLLTLLFNFGGIKEVSQAMYEGFNLMKIENWLEVLPQLISRIHQPDPTVSNSLLSLLSDLGKAHPQALVYPLTVAIKSESVSRQKAALSIIEKIRIHSPVLVNQAELVSHELIRVAVLWHELWYEGLEDASRQFFVEHNIEKMFSTLEPLHKHLGNEPQTLSEVSFQKSFGRDLNDAYEWLNNYKKSKDINNLNQAWDIYYNVFRKITRQIPQLQTLDLQHVSPQLLATHDLELAVPGTYFPGKPTIRIAKFEPLFSVISSKQRPRKFSIKGSDGKDYKYVLKGHEDIRQDSLVMQLFGLVNTLLKNDSECFKRHLDIQQYPAIPLSPKSGLLGWVPNSDTFHVLIREHRDAKKIPLNIEHWVMLQMAPDYENLTLLQKIEVFTYALDNTKGQDLYKILWLKSRSSETWLERRTTYTRSLAVMSMTGYILGLGDRHPSNLMLDRITGKVIHIDFGDCFEAAILREKYPEKVPFRLTRMLTYAMEVSGIEGSFRITCENVMRVLRDNKESLMAILEAFALDPLIHWGFDLPPQKLTEQTGIPLPLINPSELLRKGAITVEEAANMEAEQQNETKNARAMLVLRRITDKLTGNDIKRFNELDVPEQVDKLIQQATSIERLCQHYIGWCPFW

SEQ ID NO: 25494 - protein, 340 aa, Saccharomyces cerevisiae; identical to SEQ ID NO: 664

SEQ ID NO: 25495 - protein, 260 aa, Saccharomyces cerevisiae
MTINQHLQQLLFNRIDKTTSSIQQARAPQMLLDDQLKYWVLLPISIVMVLTGVLKQYIMTLITGSSANEAQPRVKLTEWQYLQWAQLLIGNGGNLSSDAFAAKKEFLVKDLTEERHLAKAKQQDGSQAGEVPNPFNDPSMSNAMMNMAKGNMASFIPQTIIMWWVNHFFAGFILMQLPFPLTAKFKEMLQTGIICQDLDVRWVSSISWYFISVLGLNPVYNLIGLNDQDMGIQAGIGGPQAPKALHNHRLTKQCMRWLTI

SEQ ID NO: 25496 - protein, 2473 aa, Saccharomyces cerevisiae
MNKYINKYTTPPNLLSLRQRAEGKHRTRKKLTHKSHSHDDEMSTTSNTDSNHNGPNDSGRVITGSAGHIGKISFVDSELDTTFSTLNLIFDKLKSDVPQERASGANELSTTLTSLAREVSAEQFQRFSNSLNNKIFELIHGFTSSEKIGGILAVDTLISFYLSTEELPNQTSRLANYLRVLIPSSDIEVMRLAANTLGRLTVPGGTLTSDFVEFEVRTCIDWLTLTADNNSSSSKLEYRRHAALLIIKALADNSPYLLYPYVNSILDNIWVPLRDAKLIIRLDAAVALGKCLTIIQDRDPALGKQWFQRLFQGCTHGLSLNTNDSVHATLLVFRELLSLKAPYLRDKYDDIYKSTMKYKEYKFDVIRREVYAILPLLAAFDPAIFTKKYLDRIMVHYLRYLKNIDMNAANNSDKPFILVSIGDIAFEVGSSISPYMTLILDNIREGLRTKFKVRKQFEKDLFYCIGKLACALGPAFAKHLNKDLLNLMLNCPMSDHMQETLMILNEKIPSLESTVNSRILNLLSISLSGEKFIQSNQYDFNNQFSIEKARKSRNQSFMKKTGESNDDITDAQILIQCFKMLQLIHHQYSLTEFVRLITISYIEHEDSSVRKLAALTSCDLFIKDDICKQTSVHALHSVSEVLSKLLMIAITDPVAEIRLEILQHLGSNFDPQLAQPDNLRLLFMALNDEIFGIQLEAIKIIGRLSSVNPAYVVPSLRKTLLELLTQLKFSNMPKKKEESATLLCTLINSSDEVAKPYIDPILDVILPKCQDASSAVASTALKVLGELSVVGGKEMTRYLKELMPLIINTFQDQSNSFKRDAALTTLGQLAASSGYVVGPLLDYPELLGILINILKTENNPHIRRGTVRLIGILGALDPYKHREIEVTSNSKSSVEQNAPSIDIALLMQGVSPSNDEYYPTVVIHNLMKILNDPSLSIHHTAAIQAIMHIFQNLGLRCVSFLDQIIPGIILVMRSCPPSQLDFYFQQLGSLISIVKQHIRPHVEKIYGVIREFFPIIKLQITIISVIESISKALEGEFKRFVPETLTFFLDILENDQSNKRIVPIRILKSLVTFGPNLEDYSHLIMPIVVRMTEYSAGSLKKISIITLGRLAKNINLSEMSSRIVQALVRILNNGDRELTKATMNTLSLLLLQLGTDFVVFVPVINKALLRNRIQHSVYDQLVNKLLNNECLPTNIIFDKENEVPERKNYEDEMQVTKLPVNQNILKNAWYCSQQKTKEDWQEWIRRLSIQLLKESPSACLRSCSSLVSVYYPLARELFNASFSSCWVELQTSYQEDLIQALCKALSSSENPPEIYQMLLNLVEFMEHDDKPLPIPIHTLGKYAQKCHAFAKALHYKEVEFLEEPKNSTIEALISINNQLHQTDSAIGILKHAQQHNELQLKETWYEKLQRWEDALAAYNEKEAAGEDSVEVMMGKLRSLYALGEWEELSKLASEKWGTAKPEVKKAMAPLAAAAWGLEQWDEIAQYTSVMKSQSPDKEFYDAILCLHRNNFKKAEVHIFNARDLLVTELSALVNESYNRAYNVVVRAQIIAELEEIIKYKKLPQNSDKRLTMRETWNTRLLGCQKNIDVWQRILRVRSLVIKPKEDAQVRIKFANLCRKSGRMALAKKVLNTLLEETDDPDHPNTAKASPPVVYAQLKYLWATGLQDEALKQLINFTSRMAHDLGLDPNNMIAQSVPQQSKRVPRHVEDYTKLLARCFLKQGEWRVCLQPKWRLSNPDSILGSYLLATHFDNTWYKAWHNWALANFEVISMLTSVSKKKQEGSDASSVTDINEFDNGMIGVNTFDAKEVHYSSNLIHRHVIPAIKGFFHSISLSESSSLQDALRLLTLWFTFGGIPEATQAMHEGFNLIQIGTWLEVLPQLISRIHQPNQIVSRSLLSLLSDLGKAHPQALVYPLMVAIKSESLSRQKAALSIIEKMRIHSPVLVDQAELVSHELIRMAVLWHEQWYEGLDDASRQFFGEHNTEKMFAALEPLYEMLKRGPETLREISFQNSFGRDLNDAYEWLMNYKKSKDVSNLNQAWDIYYNVFRKIGKQLPQLQTLELQHVSPKLLSAHDLELAVPGTRASGGKPIVKISKFEPVFSVISSKQRPRKFCIKGSDGKDYKYVLKGHEDIRQDSLVMQLFGLVNTLLQNDAECFRRHLDIQQYPAIPLSPKSGLLGWVPNSDTFHVLIREHREAKKIPLNIEHWVMLQMAPDYDNLTLLQKVEVFTYALNNTEGQDLYKVLWLKSRSSETWLERRTTYTRSLAVMSMTGYILGLGDRHPSNLMLDRITGKVIHIDFGDCFEAAILREKFPEKVPFRLTRMLTYAMEVSGIEGSFRITCENVMKVLRDNKGSLMAILEAFAFDPLINWGFDLPTKKIEEETGIQLPVMNANELLSNGAITEEEVQRVENEHKNAIRNARAMLVLKRITDKLTGNDIRRFNDLDVPEQVDKLIQQATSVENLCQHYIGWCPFW

SEQ ID NO: 25497 - protein, 466 aa, Saccharomyces cerevisiae
MSSTQVGNALSSSTTTLVDLSNSTVTQKKQYYKDGETLHNLLLELKNNQDLELLPHEQAHPKIFQALKARIGRINNETCDPGEENSFFICDLGEVKRLFNNWVKELPRIKPFYAVKCNPDTKVLSLLAELGVNFDCASKVEIDRVLSMNISPDRIVYANPCKVASFIRYAASKNVMKSTFDNVEELHKIKKFHPESQLLLRIATDDSTAQCRLSTKYGCEMENVDVLLKAIKELGLNLAGVSFHVGSGASDFTSLYKAVRDARTVFDKAANEYGLPPLKILDVGGGFQFESFKESTAVLRLALEEFFPVGCGVDIIAEPGRYFVATAFTLASHVIAKRKLSENEAMIYTNDGVYGNMNCILFDHQEPHPRTLYHNLEFHYDDFESTTAVLDSINKTRSEYPYKVSIWGPTCDGLDCIAKEYYMKHDVIVGDWFYFPALGAYTSSAATQFNGFEQTADIVYIDSELD

SEQ ID NO: 25498 - protein, 433 aa, Saccharomyces cerevisiae
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVN

SEQ ID NO: 25499 - protein, 1518 aa, Saccharomyces cerevisiae
MTGHVSKTSHVPKGRPSSLAKKAAKRAMAKVNSNPKRASGHLERVVQSVNDATKRLSQPDSTVSVATKSSKRKSRDTVGPWKLGKTLGKGSSGRVRLAKNMETGQLAAIKIVPKKKAFVHCSNNGTVPNSYSSSMVTSNVSSPSIASREHSNHSQTNPYGIEREIVIMKLISHTNVMALFEVWENKSELYLVLEYVDGGELFDYLVSKGKLPEREAIHYFKQIVEGVSYCHSFNICHRDLKPENLLLDKKNRRIKIADFGMAALELPNKLLKTSCGSPHYASPEIVMGRPYHGGPSDVWSCGIVLFALLTGHLPFNDDNIKKLLLKVQSGKYQMPSNLSSEARDLISKILVIDPEKRITTQEILKHPLIKKYDDLPVNKVLRKMRKDNMARGKSNSDLHLLNNVSPSIVTLHSKGEIDESILRSLQILWHGVSRELITAKLLQKPMSEEKLFYSLLLQYKQRHSISLSSSSENKKSATESSVNEPRIEYASKTANNTGLRSENNDVKTLHSLEIHSEDTSTVNQNNAITGVNTEINAPVLAQKSQFSINTLSQPESDKAEAEAVTLPPAIPIFNASSSRIFRNSYTSISSRSRRSLRLSNSRLSLSASTSRETVHDNEMPLPQLPKSPSRYSLSRRAIHASPSTKSIHKSLSRKNIAATVAARRTLQNSASKRSLYSLQSISKRSLNLNDLLVFDDPLPSKKPASENVNKSEPHSLESDSDFEILCDQILFGNALDRILEEEEDNEKERDTQRQRQNDTKSSADTFTISGVSTNKENEGPEYPTKIEKNQFNMSYKPSENMSGLSSFPIFEKENTLSSSYLEEQKPKRAALSDITNSFNKMNKQEGMRIEKKIQREQLQKKNDRPSPLKPIQHQELRVNSLPNDQGKPSLSLDPRRNISQPVNSKVESLLQGLKFKKEPASHWTHERGSLFMSEHVEDEKPVKASDVSIESSYVPLTTVATSSRDPSVLAESSTIQKPMLSLPSSFLNTSMTFKNLSQILADDGDDKHLSVPQNQSRSVAMSHPLRKQSAKISLTPRSNLNANLSVKRNQGSPGSYLSNDLDGISDMTFAMEIPTNTFTAQAIQLMNNDTDNNKINTSPKASSFTKEKVIKSAAYISKEKEPDNSDTNYIPDYTIPNTYDEKAINIFEDAPSDEGSLNTSSSESDSRASVHRKAVSIDTMATTNVLTPATNVRVSLYWNNNSSGIPRETTEEILSKLRLSPENPSNTHMQKRFSSTRGSRDSNALGISQSLQSMFKDLEEDQDGHTSQADILESSMSYSKRRPSEESVNPKQRVTMLFDEEEEESKKVGGGKIKEEHTKLDNKISEESSQLVLPVVEKKENANNTENNYSKIPKPSTIKVTKDTAMESNTQTHTKKPILKSVQNVEVEEAPSSDKKNWFVKLFQNFSSHNNATKASKNHVTNISFDDAHMLTLNEFNKNSIDYQLKNLDHKFGRKVVEYDCKFVKGNFKFKIKITSTPNASSVITVKKRSKHSNTSSNKAFEKFNDDVERVIRNAGRS

SEQ ID NO: 25500 - protein, 571 aa, Saccharomyces cerevisiae
MTDEKVNSDQNMNGKQGVNLISSLPTTQVPVSILTNKERRKSIHDESNFERSDSHEDQSKSNSNRRNIYKNDYSTNLRDFSFANLKQNSERNKDGHEIQINTSMPANTNGQQKRFSPSLPSAVSFTVPEVERLPYHRYSISNKPGKQQQQQEQLQQNQQQEEQQKAQLQEQNQRAKQQEEVKQIQEQVQKKQTERQQLIDEKERIANAIFKENTTNDGTDIRKHSVSSGTSNSEDEVDSPSMEKNSIVHMPGDFIYFNPKSNASKPITAKAAPLSANNSTHKNKEVITAPTGPRVPFTEFFQKEDDKKFHILIGATGSVATIKVPLIIDKLFKIYGPEKISIQLIVTKPAEHFLKGLKMSTHVKIWREEDAWVFDAVNKNDTSLSLNLILHHELRKWADIFLIAPLSANTLAKLANGICNNLLTSVMRDWSPLTPVLIAPAMNTFMYINPMTKKHLTSLVQDYPFIQVLKPVEKVLICGDIGMGGMREWTDIVEIVRRRINEIRKARDEETGDKEQEQEEQEGADNEDDDDEDDEEDEEDEEEEEALNETASDESNDEEDEEDEEDVKTEV

SEQ ID NO: 25501 - protein, 499 aa, Saccharomyces cerevisiae
MSTKKHTKTHSTYAFESNTNSVAASQMRNALNKLADSSKLDDAARAKFENELDSFFTLFRRYLVEKSSRTTLEWDKIKSPNPDEVVKYEIISQQPENVSNLSKLAVLKLNGGLGTSMGCVGPKSVIEVREGNTFLDLSVRQIEYLNRQYDSDVPLLLMNSFNTDKDTEHLIKKYSANRIRIRSFNQSRFPRVYKDSLLPVPTEYDSPLDAWYPPGHGDLFESLHVSGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLIESSNLEMEIIPNQKTITRDGHEINVLQLETACGAAIRHFDGAHGVVVPRSRFLPVKTCSDLLLVKSDLFRLEHGSLKLDPSRFGPNPLIKLGSHFKKVSGFNARIPHIPKIVELDHLTITGNVFLGKDVTLRGTVIIVCSDGHKIDIPNGSILENVVVTGNLQILEH

SEQ ID NO: 25502 - protein, 758 aa, Saccharomyces cerevisiae
MEIDGNTLVFIIVILFLFFSSPGGDGVSSQYEFNQLQRLKQQFRTEHNTFVNMTYTDSFRNITGLKLSYQDMLNNPLQNATYPLPGKDYDRWFPNQNYMVLPNDVIEAINTEVWNTSNDDASNLFPPNITSTLLGKIDLVSNNKYEKIRMPVPRFYEPATDFSEDIPPEGETYWSEWPSYGELHNVSFQHGEIAIQISHMSNLQDNNNYLRRNFINKKNDRWKLLNLQIDFSDKAEKEKHSIYSKAVYDIQRGRILSISQSSKFHSLFALPHYMSFQNDYNEKIFNDVKELVDEFWNFTDYTDVMTMKDVQDAYNNANFKCEYLIFLQLEPWNQYTRDQIKLIDDELNWPLGRPANLSSLPPINVVSGLLYSPDCGVRLGLHNVKGTRYELKIMSIRKHLLFGIALFAAQIYLLLTQMHHTNTPSMVNKISFYCFSMINLVDGSLATLYFVAASVVPELYLPLVISAFSCFILASIFEIRYLISIYASQVNEQNVGIINLLRGNTGTYDENRPRPAFIPDEGSIGGSLYGRFFFMLIIFTFLILSSTSWPRQLRMVFEYILIFILNSYWIPQIFRNAVKGIPSRRERARSSIGGNRSQNKMPLLWSFVIGTTIIRSLPVVYVFTYSSNVFRHHKDVHFVVFLSLWLLFQISILYSQDVLGSRWFLPKHTIPDGYSYFKPLSNEYISEHGGGTAEHTVDCAICMSDVPIYIEEIPETHKVDQHSYMVTPCNHVFHTSCLENWMNYKLQCPVCRSPLPPL

SEQ ID NO: 25503 - protein, 562 aa, Saccharomyces cerevisiae; identical to SEQ ID NO: 674

SEQ ID NO: 25504 - protein, 601 aa, Saccharomyces cerevisiae
MLNHPSQGSDDAQDEKQGDFPVIEEEKTQAVTLKDSYVSDDVANSTERYNLSPSPEDEDFEGPTEEEMQTLRHVGGKIPMRCWLIAIVELSERFSYYGLSAPFQNYMEYGPNDSPKGVLSLNSQGATGLSYFFQFWCYVTPVFGGYVADTFWGKYNTICCGTAIYIAGIFILFITSIPSVGNRDSAIGGFIAAIILIGIATGMIKANLSVLIADQLPKRKPSIKVLKSGERVIVDSNITLQNVFMFFYFMINVGSLSLMATTELEYHKGFWAAYLLPFCFFWIAVVTLIFGKKQYIQRPIGDKVIAKSFKVCWILTKNKFDFNAAKPSVHPEKNYPWNDKFVDEIKRALAACKVFIFYPIYWTQYGTMISSFITQASMMELHGIPNDFLQAFDSIALIIFIPIFEKFVYPFIRRYTPLKPITKIFFGFMFGSFAMTWAAVLQSFVYKAGPWYNEPLGHNTPNHVHVCWQIPAYVLISFSEIFASITGLEYAYSKAPASMKSFIMSIFLLTNAFGSAIGCALSPVTVDPKFTWLFTGLAVACFISGCLFWLCFRKYNDTEEEMNAMDYEEEDEFDLNPISAPKANDIEILEPMESLRSTTKY

SEQ ID NO: 25505 - protein, 324 aa, Saccharomyces cerevisiae; identical to SEQ ID NO: 848

SEQ ID NO: 25506 - protein, 503 aa, Saccharomyces cerevisiae
MLCAISGKVPRRPVLSPKSRTIFEKSLLEQYVKDTGNDPITNEPLSIEEIVEIVPSAQQASLTESTNSATLKANYSIPNLLTSLQNEWDAIMLENFKLRSTLDSLTKKLSTVMYERDAAKLVAAQLLMEKNEDSKDLPKSSQQAVAITREEFLQGLLQSSRDFVARGKLKAPKWPILKNLELLQAQNYSRNIKTFPYKELNKSMYYDKWVCMCRCEDGALHFTQLKDSKTITTITTPNPRTGGEHPAIISRGPCNRLLLLYPGNQITILDSKTNKVLREIEVDSANEIIYMYGHNEVNTEYFIWADNRGTIGFQSYEDDSQYIVHSAKSDVEYSSGVLHKDSLLLALYSPDGILDVYNLSSPDQASSRFPVDEEAKIKEVKFADNGYWMVVECDQTVVCFDLRKDVGTLAYPTYTIPEFKTGTVTYDIDDSGKNMIAYSNESNSLTIYKFDKKTKNWTKDEESALCLQSDTADFTDMDVVCGDGGIAAILKTNDSFNIVALTP

SEQ ID NO: 25507 - protein, 868 aa, Saccharomyces cerevisiae
MNATKELTFNLLNKFQDKERFGSAQRHAGISLKGFISGILFSFLYFLFQLSLFIILRSRFKTIYQANVVLKIHPGSKVCFAKKKIKNYWSLFAFLKQLPGRMLDPMEKFERNERYGLDNYLFLRFLKLLIFFFAVLSIINIPILIPIHYFSRDILKENEGERYEQSFRTTSKLDKWTMSNLSPNSSNTLICHLFLSIFVVLWFHFILSSELRFVNRLGYSVLTKSKYQNILYLEGFSSKLVTQSISLETFFQPLHSDCFGVTHFIPKNLKKVHKLEIKLNKLQKSKEQIIFEIILEKYFRRVSIHRHLIANHKRFFFSKLKNHLLFQYKKLVFLTQFRISYYCTKIRLRWKKSSIFPLYYPKLYVNTETILERKYRILDKIIRKEKLIKFQVNSLKATSETKQALPDDLSSGTDIYMDKMFITFKSTLLSNVIGELLSYRLPTQNLKVIIGPNVNDIIWRNILDSSPLWKSAKYFSANILRIFVIIGWILPVAFLGLISQIPNISSLIPFTKIIHFQSPFIREVAKNLIPIVTLIIIIEIVPYFFRWLSYLRGLKTGAQIEADVQNWYFVFVFIHLFVVVTISSGFSIIIERLLNNPVSIPALLANDLPKCANFFCSFVLIRGMAYAGGNLLRIKELLFELFYYKWKRSTPHAQFKRLKTSLFFQLGSIYPIFSVLGCIGIIYSVVAPIILLLCCISFSMVFFSFSYLFKYQYNKENYSETFGKLYIQALMQLYAGIYFMEFCLLGLFTLFDQYTLSTIMLVVFALTVITHSKISKQIKSKPQRIPTLEYLSNLTEERKDQFCQESYTFHDIFSICRNSDEIWLPRDKLGISEEEQSFLEKSYHLKFDLNMYSMNLFGDCHLENSHLH

SEQ ID NO: 25508 - protein, 365 aa, Saccharomyces cerevisiae
MDLVLEVADHYVLDDLYAKVLPASLAANIPVKWQKLLGLNSGFSNSTILQETLNSKNAVKECRRFYGQVPFLFDMSTTSFASLLPRSSILREFLSLWVIVTIFGLLLYLFTASLSYVFVFDKSIFNHPRYLKNQMAMEIKLAVSAIPWMSMLTVPWFVMELNGHSKLYMKIDYENHGVRKLIIEYFTFIFFTDCGVYLAHRWLHWPRVYRALHKPHHKWLVCTPFASHSFHPVDGFLQSISYHIYPLILPLHKVSYLILFTFVNFWTVMIHDGQYLSNNPAVNGTACHTVHHLYFNYNYGQFTTLWDRLGGSYRRPDDSLFDPKLRDAKETWDAQVKEVEHFIKEVEGDDNDRIYENDPNTKKNN

SEQ ID NO: 25509 - protein, 1147 aa, Saccharomyces cerevisiae
MPNPNTADYLVNPNFRTSKGGSLSPTPEAFNDTRVAAPATLRMMGKQSGPRNDQQQAPLMPPADIKQGKEQAAQRQNDASRPNGAVELRQFHRRSLGDWEFLETVGAGSMGKVKLVKHRQTKEICVIKIVNRASKAYLHKQHSLPSPKNESEILERQKRLEKEIARDKRTVREASLGQILYHPHICRLFEMCTMSNHFYMLFEYVSGGQLLDYIIQHGSLKEHHARKFARGIASALQYLHANNIVHRDLKIENIMISSSGEIKIIDFGLSNIFDYRKQLHTFCGSLYFAAPELLKAQPYTGPEVDIWSFGIVLYVLVCGKVPFDDENSSILHEKIKKGKVDYPSHLSIEVISLLTRMIVVDPLRRATLKNVVEHPWMNRGYDFKAPSYVPNRVPLTPEMIDSQVLKEMYRLEFIDDIEDTRRSLIRLVTEKEYIQLSQEYWDKLSNAKGLSSSLNNNYLNSTAQQTLIQNHITSNPSQSGYNEPDSNFEDPTLAYHPLLSIYHLVSEMVARKLAKLQRRQALALQAQAQQRQQQQQVALGTKVALNNNSPDIMTKMRSPQKEVVPNPGIFQVPAIGTSGTSNNTNTSNKPPLHVMVPPKLTIPEQAHTSPTSRKSSDIHTELNGVLKSTPVPVSGEYQQRSASPVVGEHQEKNTIGGIFRRISQSGQSQHPTRQQEPLPEREPPTYMSKSNEISIKVPKSHSRTISDYIPSARRYPSYVPNSVDVKQKPAKNTTIAPPIRSVSQKQNSDLPALPQNAELIVQKQRQKLLQENLDKLQINDNDNNNVNAVVDGINNDNSDHYLSVPKGRKLHPSARAKSVGHARRESLKFTRPPIPAALPPSDMTNDNGFLGEANKERYNPVSSNFSTVPEDSTTYSNDTNNRLTSVYSQELTEKQILEEASKAPPGSMPSIDYPKSMFLKGFFSVQTTSSKPLPIVRHNIISVLTRMNIDFKEVKGGFICVQQRPSIETAAVPVITTTGVGLDSGKAMDLQNSLDSQLSSSYHSTASSASRNSSIKRQGSYKRGQNNIPLTPLATNTHQRNSSIPMSPNYGNQSNGTSGELSSMSLDYVQQQDDILTTSRAQNINNVNGQTEQTNTSGIKERPPIKFEIHIVKVRIVGLAGVHFKKVSGNTWLYKELASYILKELNL

SEQ ID NO: 25510 - protein, 435 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 25511 - protein, 460 aa, Saccharomyces cerevisiae
MMLEGYTVQPPQSTLIGDIEIQDENANQEVKNVLYQGVQKGIKRLEKRQRRVALGDVTSQKANKIHNAIHNKFHQTKNNFEIENIRSSALVKEQQRDVRHEDSDYFLIDSSEGSSTDDEQVNEDAIDDLLSRRVNDQQIQADEVYEDFDGEMQDVIEEDVDSQIEPLSPINNDEIQTELDRAFEKYFRSVPNPLDDDTHDVVMVVEYASDIFYYLRELEVKYRPNPYYMQNQVELTWPFRRTMIDWLVQLHFRFQLLPETLYLTINIVDRFLSKKTVTLNRFQLVGVSALFIAAKFEEINCPTLDDLVYMLENTYTRDDIIRAEQYMIDTLEFEIGWPGPMPFLRRISKADDYDFEPRTLAKYLLETTIVEPKLVAAAPSWLAAGAYFLSRTILGSNDWSLKHVFYSGYTSSQIIPLASLILENCKNASRRHHSIWKKYFDQKHYRCSQIVEEWIVSTEA

SEQ ID NO: 25512 - protein, 782 aa, Saccharomyces cerevisiae
MTSYIERLKSAASYLDTVPDEHHDFRKPTAKVVTTQLTIATSLGIFALLSFSILLKKWPRLYASRRYKDDGNLRLPSWNQSSLFGWLTVLYKIRDEQILEYAGLDAYVFLSFFKMCIKLLSIFCFFSVCVISPVRYHFTGKIDDGNDDDDSESSLIHLVKRIVEGSGDGDNHSAPERTNVYLWMYVLFTYFFTFIAIKMAVAETKHVVSTRQAYLGKQNTITDRTIRLSGIPIELRDSEALKTRIEQLKIGTVSSITICREWGPLNKLFHCRKKILKNLELKYSECPRELRTRQPYSENYHLLGNEQSGAVTHGENVPSSNNNDEDTILYSQISLGERPKMKIGYRGIFGKEVDAIEYLEQQLKFIDAEIIEARKQHYSATPTAFVTMDSVANAQMAAQAVLDPRVHYFITRLAPAPHDIKWDHVCLSRKDRLTKVYSTTVFIGLSSLFLVIPVSYLATLLNLKTLSKFWPSVGQLLKDHQWAANIVTGLLPTYLFTLLNFGIPYFYEYLTSYQGLVSYSEEEISLVSKNFFYIFVNLFLVFTLAGTASNYWAYLSDTTKIAYQLATSVKEFSLFYVDLIILQGIGMFPFKLLLVGSLIGFPLVKIKAKTPRQRNELYNPPIFNFGLQLPQPILILIITLIYSVMSTKILTSGLAYFIIGFYVYKYQLIFATDHLPHSTGKVWPLIFRRIIVGLLLFQLTMTGTLAGFEGGWVLSSCLFPLPVVTLCFLYDFEKNYLPLSKYIALSSIREYERDNSTVNSANEEESYAYPYAVSELEGPMLD

SEQ ID NO: 25513 - protein, 312 aa, Saccharomyces cerevisiae
MGGIREKKAEYFAKLREYLEEYKSLFVVGVDNVSSQQMHEVRKELRGRAVVLMGKNTMVRRAIRGFLSDLPDFEKLLPFVKGNVGFVFTNEPLTEIKNVIVSNRVAAPARAGAVAPEDIWVRAVNTGMEPGKTSFFQALGVPTKIARGTIEIVSDVKVVDAGNKVGQSEASLLNLLNISPFTFGLTVVQVYDNGQVFPSSILDITDEELVSHFVSAVSTIASISLAIGYPTLPSVGHTLINNYKDLLAVAIAASYHYPEIEDLVDRIENPEKYAAAAPAATSAASGDAAPAEEAAAEEEEESDDDMGFGLFD

SEQ ID NO: 25514 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 25515 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 25516 - protein, 686 aa, Saccharomyces cerevisiae
MTDITPVQNDVDVNGNNVNDDVSSNLKRPIDQGDPSNGLAEEENPANNQLHLKKARLDGDALTSSPAGLAENGIEGATLAANGENGYNATGSGAEDEQQGLKKEEGGQGTKQEDLDENSKQELPMEVPKEPAPAPPPEPDMNNLPQNPIPKHQQKHALLAIKAVKRLKDARPFLQPVDPVKLDIPFYFNYIKRPMDLSTIERKLNVGAYEVPEQITEDFNLMVNNSIKFNGPNAGISQMARNIQASFEKHMLNMPAKDAPPVIAKGRRSSAQEDAPIVIRRAQTHNGRPKRTIHPPKSKDIYPYESKKPKSKRLQQAMKFCQSVLKELMAKKHASYNYPFLEPVDPVSMNLPTYFDYVKEPMDLGTIAKKLNDWQYQTMEDFERDVRLVFKNCYTFNPDGTIVNMMGHRLEEVFNSKWADRPNLDDYDSDEDSRTQGDYDDYESEYSESDIDETIITNPAIQYLEEQLARMKVELQQLKKQELEKIRKERRLARGSKKRGKRSKGRSGSKNASSKGRRDKKNKLKTVVTYDMKRIITERINDLPTSKLERAIDIIKKSMPNISEDDEVELDLDTLDNHTILTLYNTFFRQYESSSGASNGLDGTSGVTRDASSLSPTSAGSRKRRSKALSQEEQSRQIEKIKNKLAILDSASPLSQNGSPGQIQSAAHNGFSSSSDDDVSSESEEE

SEQ ID NO: 25517 - protein, 523 aa, Saccharomyces cerevisiae
MAAVRDYKTALEFAKSLPRLDGLSVQELMDSKTRGGLTYNDFLVLPGLVDFPSSEVSLQTKLTRNITLNTPFVSSPMDTVTESEMAIFMALLGGIGFIHHNCTPEDQADMVRRVKNYENGFINNPIVISPTTTVGEAKSMKERFGFSGFPVTEDGKRNGKLMGIVTSRDIQFVEDNSLLVQDVMTKNPVTGAQGITLSEGNEILKKIKKGKLLIVDDNGNLVSMLSRTDLMKNQNYPLASKSATTKQLLCGAAIGTIDADKERLRLLVEAGLDVVILDSSQGNSIFQLNMIKWIKETFPDLEIIAGNVATREQAANLIAAGADGLRIGMGSGSICITQEVMACGRPQGTAVYNVCEFANQFGIPCMADGGVQNIGHITKALALGSSTVMMGGMLAGTTESPGEYFYQDGKRLKAYRGMGSIDAMQKTGTKGNASTSRYFSESDSVLVAQGVSGAVVDKGSIKKFIPYLYNGLQHSCQDIGYKSLTLLKENVQSGKVRFEFRTASAQLEGGVHNLHSYEKRLHN

SEQ ID NO: 25518 - protein, 524 aa, Saccharomyces cerevisiae
MSAAPLDYKKALEHLKTYSSKDGLSVQELMDSTTRGGLTYNDFLVLPGLVNFPSSAVSLQTKLTKKITLNTPFVSSPMDTVTEADMAIYMALLGGIGFIHHNCTPKEQASMVKKVKMFENGFINSPIVISPTTTVGEVKVMKRKFGFSGFPVTEDGKCPGKLVGLVTSRDIQFLEDDSLVVSEVMTKNPVTGIKGITLKEGNEILKQTKKGKLLIVDDNGNLVSMLSRADLMKNQNYPLASKSATTKQLLCGAAIGTIEADKERLRLLVEAGLDVVILDSSQGNSVFQLNMIKWIKETFPDLEIIAGNVATREQAANLIAAGADGLRIGMGSGSICITQEVMACGRPQGTAVYNVCQFANQFGVPCMADGGVQNIGHITKALALGSSTVMMGGMLAGTTESPGEYFYKDGKRLKAYRGMGSIDAMQKTGNKGNASTSRYFSESDSVLVAQGVSGAVVDKGSIKKFIPYLYNGLQHSCQDIGCESLTSLKENVQNGEVRFEFRTASAQLEGGVHNLHSYEKRLYN

SEQ ID NO: 25519 - protein, 442 aa, Saccharomyces cerevisiae
MNRTVFLAFVFGWYFCSIALSIYNRWMFDPKDGLGIGYPVLVTTFHQATLWLLSGIYIKLRHKPVKNVLRKNNGFNWSFFLKFLLPTAVASAGDIGLSNVSFQYVPLTIYTIIKSSSIAFVLLFGCIFKLEKFHWKLALSVIIMFVGVALMVFKPSDSTSTKNDQALVIFGSFLVLASSCLSGLRWVYTQLMLRNNPIQTNTAAAVEESDGALFTENEDNVDNEPVVNLANNKMLENFGESKPHPIHTIHQLAPIMGITLLLTSLLVEKPFPGIFSSSIFRLDTSNGGVGTETTVLSIVRGIVLLILPGFAVFLLTICEFSILEQTPVLTVSIVGIVKELLTVIFGIIILSERLSGFYNWLGMLIIMADVCYYNYFRYKQDLLQKYHSVSTQDNRNELKGFQDFEQLGSKKIAPYSISVDLTNQEYELDMIAQNVSRSSQQV

SEQ ID NO: 25520 - protein, 211 aa, Saccharomyces cerevisiae [sequence omitted]

SEQ ID NO: 25521 - protein, 636 aa, Saccharomyces cerevisiae
MTNALLSIAVLLFSMLSLAQAETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYDYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDTGTHPFHLHGHAFQTIQRDRTYDDALGEVPHSFDPDNHPAFPEYPMRRDTLYVRPQSNFVIRFKADNPGVWFFHCHIEWHLLQGLGLVLVEDPFGIQDAHSQQLSENHLEVCQSCSVATEGNAAANTLDLTDLTGENVQHAFIPTGFTKKGIIAMTFSCFAGILGIITIAIYGMMDMEDATEKVIRDLHVDPEVLLNEVDENEERQVNEDRHSTEKHQFLTKAKRFF

SEQ ID NO: 25522 - protein, 319 aa, Saccharomyces cerevisiae
MASNEVLVLRGTLEGHNGWVTSLATSAGQPNLLLSASRDKTLISWKLTGDDQKFGVPVRSFKGHSHIVQDCTLTADGAYALSASWDKTLRLWDVATGETYQRFVGHKSDVMSVDIDKKASMIISGSRDKTIKVWTIKGQCLATLLGHNDWVSQVRVVPNEKADDDSVTIISAGNDKMVKAWNLNQFQIEADFIGHNSNINTLTASPDGTLIASAGKDGEIMLWNLAAKKAMYTLSAQDEVFSLAFSPNRYWLAAATATGIKVFSLDPQYLVDDLRPEFAGYSKAAEPHAVSLAWSADGQTLFAGYTDNVIRVWQVMTAN

SEQ ID NO: 25523 - protein, 585 aa, Saccharomyces cerevisiae
MLHRHGSKQKNFENIAGKVVHDLAGLQLLSNDVQKSAVQSGHQGSNNMRDTSSQGMANKYSVPKKGLPADLSYQLIHNELTLDGNPHLNLASFVNTFTTDQARKLIDENLTKNLADNDEYPQLIELTQRCISMLAQLWHANPDEEPIGCATTGSSEAIMLGGLAMKKRWEHRMKNAGKDASKPNIIMSSACQVALEKFTRYFEVECRLVPVSHRSHHMLDPESLWDYVDENTIGCFVILGTTYTGHLENVEKVADVLSQIEAKHPDWSNTDIPIHADGASGGFIIPFGFEKEHMKAYGMERWGFNHPRVVSMNTSGHKFGLTTPGLGWVLWRDESLLADELRFKLKYLGGVEETFGLNFSRPGFQVVHQYFNFVSLGHSGYRTQFQNSLFVARAFSFELLNSSKLPGCFEIVSSIHESIENDSAPKSVKDYWEHPQAYKPGVPLVAFKLSKKFHEEYPEVPQAILSSLLRGRGWIIPNYPLPKATDGSDEKEVLRVVFRSEMKLDLAQLLIVDIESILTKLIHSYEKVCHHIELASEQTPERKSSFIYEMLLALASPQDDIPTPDEIEKKNKLKETTTRNYRGTC

SEQ ID NO: 25524 - protein, 953 aa, Saccharomyces cerevisiae
MNSTNSTNSTTTATSTNTSTQQVVTSLVSNGTIFGVFVIAFLILRIKLKRIYEPKSSFNLINEEKKPEPLPQGVWQWLKPLLKKSDNFVIQQAGLDGYFFLRYLFIIAIYCAVSMSYIFPILLSINASNGNHESGLNQLAYQNVKHRGRYFAHVFCGWIFFWGFLYIIYRELYFYTSMKQAVLASPRYAKKLSSRTVLFQTVPKQYLSEEEFSKLFDGVKRVWIARGSGSIEAMVKARDNMAIQLEGAETKYLKAALKKIKKLNKKSPQLSVSDNIAEYVPDKKRPHHKINKVAKFFFGKKVDTISYIKEELPKLNQKVKALQEDHENSSPFNSVFVEFESQYQAQVAAQITTYHAPLFMTPVYIGIEPSDVVWFNLRMFWWERLGREVSAVSAIVALVILWAFPVAFVGMISNITSLTNEVKWLKFIYKLPKQLLGLLTSLAPTVALAVLMSFLPKFIRGMAITQGAPSKQNVEYFTQQAYFAFQVIQVFLVTTLSSAATSTVTEIVKEPTKAMDLLASNLPKASNFFMSYVILQGLSISSGALLQIVPLILFYVLGAFLDGTVRKKWNRFCGLSSMQWGTAFPVYTNLAVITFSYSIISPLILLFAAVAFFLLYIAYLYNLTYVYQESPDARGIYYPRALFQTIVGIYIGQICLLGLFAVGKGWGPIVLQVIGICVTVLIHLHLSAAFDHLSKVIPVDTMKPLDGVSDTPSFKNIYKGIESTKVKKNTFGANIDMDGIKELPEFPIKKYHKRSESVTEQQVENSIFSENTFEYQFNPANEANADGHAINAENLIEDVPLLADGDTMKIPPAPWWKRFLKPHIYYSYKAVKSRLPEIYGLVDPDERVNDFDISHAYDYPAVSAQCPELWIPRDPFGFSKLLISDVSGVVEMNDENATIDENLKFTLRDVPPPYNDVKDEANGEANGEFDTASKENNPFADPKYKEEESRSAV

SEQ ID NO: 25525 - protein, 105 aa, Saccharomyces cerevisiae
MMDLGDKINPNLSFLGINCVSFNQSPDILESLHQALPNMALLAYPNSGEVYDTEKKIWLPNSDKLNSWDTVVKQYISSGARIIGGCCRTSPKDIQEISAAVKKYT

SEQ ID NO: 25526 - protein, 437 aa, Saccharomyces cerevisiae [sequence omitted]

SEQ ID NO: 25527 - protein, 323 aa, Saccharomyces cerevisiae
MSGSFWTSTQRHHWQYTKASLAKERQKLWLLECQLFPQGLNIVMDSKQNGIEQSITKNIPITHRDLHYDKDYNLRIYCYFLIMKLGRRLNIRQYALATAHIYLSRFLIKASVREINLYMLVTTCVYLACKVEECPQYIRTLVSEARTLWPEFIPPDPTKVTEFEFYLLEELESYLIVHHPYQSLKQIVQVLKQPPFQITLSSDDLQNCWSLINDSYINDVHLLYPPHIIAVACLFITISIHGKPTKGSSLASAASEAIRDPKNSSSPVQIAFNRFMAESLVDLEEVMDTIQEQITLYDHWDKYHEQWIKFLLHTLYLRPASAI

SEQ ID NO: 25528 - protein, 222 aa, Saccharomyces cerevisiae
MSNDPGNEVSSLYPPPPPYVKFFTQSNLEKLPKYKEKKAASAKQTAPNNSNGGSEEEITCALDYLIPPPMPKNQQYRAFGSIWQVKDQLPDLESMGLTQLYKKSTENESTNYQYKIQELRKLLKSLLLNYLELIGVLSINPDMYERKVENIRTILVNIHHLLNEYRPHQSRESLIMLLEEQLEYKRGEIREIEQVCKQVHDKLTSIQDTLRTGSQSPPSSSQ

SEQ ID NO: 25529 - protein, 121 aa, Saccharomyces cerevisiae
MSNEVDRMDVDEDESQNIAQSSNQSAPVETKKKRFEIKKWTAVAFWSWDIAVDNCAICRNHIMEPCIECQPKAMTDTDNECVAAWGVCNHAFHLHCINKWIKTRDACPLDNQPWQLARCGR

SEQ ID NO: 25530 - protein, 612 aa, Saccharomyces cerevisiae
MAEMKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 25531 - protein, 991 aa, Saccharomyces cerevisiae
MADSSSTSAFISTLIIYGLTAVVFVWLFLLLRPKNRRVYEPRSLKDIQTIPEEERTEPVPEGYFGWVEYLLSKPHSFLIQHTSVDGYFLLRYIGIVGSLSFVGCLLLLPILLPVNATNGNNLQGFELLSFSNVTNKNRFYAHVFLSWIFFGLFTYVIYKELYYYVVFRHAMQTTPLYDGLLSSRTVIVTELHKSIAQEGEMQMRFPKASNVAFAYDLSDLQELCKERAKNAAKYEAALNKVLNKCVKMTRNKTQKQLDKLYNNGTKPKDDLETYVPHKKRPKHRLGKLPLCLGGKKVNTLSYSSKRIGELNEEIHEKQADWASNDRQPACFIQFETQLEAQRCYQSVEAILGKKNFGKRLIGYSPEDVNWGSMRLSSKERHSRRAVANTIMVLLIIFWAFPVAVVGIISNVNFLTDKVPFLRFINNMPTFLMGVITGLLPTIALVVLMSLVPPFIVMLGKLSGCVTRQETDLYSQAWYYAFAVIQIFLVVTATSSASSTVDSIIDRPRSAMTLLANNLPKASNFYIMYFILKGLTGPTWTILQAVNLLLSKVLGRVLDSTPRQKWNRYNTLATPRMGIVYPGIEILVCIYICYSIIAPILLFFSTVMLTLLYVAYLYNLNYVFGFSFDLKGRNYPRALFQIFVGIYLSEVCLLGLFIMAKTWGPLVLEVFWIVVTALAHIYMKRKFIPLFDAVPLSAIRHARGEPGYSYPTSDLGLQEIKDIADEMKGKYEQDNTHGILTPVTKDDLKKANLIPDNDGSSENGTPSNPFESGSERASLSGSNAESDSIKKLNDTVIKKSSTLSSSTKDNNESTFVPEGEKFRKFHYSDVEALRNKRPYDEDDHSKHGPEGAVPVNADAGVIYSDPAAVMKEPQAFPPDVLETNTWTRRILQFFNPRRSYPFDSVRMRFPLVFNTSIEYDEEYLSSAYTDPCVREKDPIVWCCKDPLGVSKQQIQEARSNGLDVRDDFTRYDEKGKVIFTYNPPDYEPEAKK

SEQ ID NO: 25532 - protein, 134 aa, Saccharomyces cerevisiae
MSGKAHGGKGKSGAKDSGSLRSQSSSARAGLQFPVGRIKRYLKRHATGRTRVGSKAAIYLTAVLEYLTAEVLELAGNAAKDLKVKRITPRHLQLAIRGDDELDSLIRATIASGGVLPHINKALLLKVEKKGSKK

SEQ ID NO: 25533 - protein, 258 aa, Saccharomyces cerevisiae
MGSRSENVGTVTREGSRVEQDDVLMDDDSDSSEYVDMWIDLFLGRKGHEYFCDVDPEYITDRFNLMNLQKTVSKFSYVVQYIVDDLDDSILENMTHARLEQLESDSRKLYGLIHARYIITIKGLQKMYAKYKEADFGRCPRVYCNLQQLLPVGLHDIPGIDCVKLYCPSCEDLYIPKSSRHSSIDGAYFGTSFPGMFLQAFPDMVPKHPTKRYVPKIFGFELHKQAQLTRWQELQRLKLVEKLESKDVDLTKSGGFKT

SEQ ID NO: 25534 - protein, 674 aa, Saccharomyces cerevisiae
MTNKSSLKNNRKGVASNTLSGAEQANIGSSAMPDTNSTGPFSSVSSLDTPVVRKSTSPTGSQTKSIMNASGTSGAVVSNTPEPGLKRIPTVTFSDPKLGSLRSDVEQTPPNQVARQSSEKKATSVHIAAEGANQGRNLKDINTKVPKDGEASASSFSTPTSILSNADMGNNISSLLAKKLSFTGGTDSILNSDNSSDSPRKEHPHFYVEDPLHTPSVRSRSNSTSPRPSVVVNTFNPINIEREGSISKTGEPTLLESVLEEAMSPNAVSNPLKRENIMTNMDPRLPQDDGKLHVLFGATGSLSVFKLKHMIRKLEEIYGRDKICIQVILTNSATKFFAMKYMRKNKKQHNSIDTSFNSTNSNAGNITGNKKKVASLEKFSIQKTSSNSAASQTNNKQEEEKQMASTTGFPSTLGGSRTYSNSSNVVSQHPQIELPAHIQFWTDQDEWDVWRQRTDPVLHIELRRWADILVVAPLTANTLAKIALGLCDNLLTSVIRAWNPTFPIFLAPSMGSGTFNSIMTKKHFRIIQEEMPWVTVFKPSEKVMGINGDIGLSGMMDANEIVGKIVVKLGGYPDVSAGKEEEEDEDNDEEDDNKKNDTGGKDEDNDDDDDDDDDDDDDDDDDDDDDDDDDDDDDDDDDDDDDDDDDDDDDEDDEDEDEDDEGKKKEDKGGLQRS

SEQ ID NO: 25535 - protein, 339 aa, Saccharomyces cerevisiae
MPLPPSTLNQKSNRVYSVARVYKNACEERPQEYWDYEQGVTIDWGKISNYEIINKIGRGKYSEVFSGRCIVNNQKCVIKVLKPVKMKKIYRELKILTNLTGGPNVVGLYDIVQDADSKIPALIFEEIKNVDFRTLYPTFKLPDIQYYFTQLLIALDYCHSMGIMHRDVKPQNVMIDPTERKLRLIDWGLAEFYHPGVDYNVRVASRYHKGPELLVNLNQYDYSLDLWSVGCMLAAIVFKKEPFFKGSSNPDQLVKIATVLGTKELLGYLGKYGLHLPSEYDNIMRDFTKKSWTHFITSETKLAVPEVVDLIDNLLRYDHQERLTAKEAMDHKFFKTKFE

SEQ ID NO: 25536 - protein, 133 aa, Saccharomyces cerevisiae; identical to SEQ ID NO: 788

SEQ ID NO: 25537 - protein, 312 aa, Saccharomyces cerevisiae
MPATLHDSTKILSLNTGAQIPQIGLGTWQSKENDAYKAVLTALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIKTNRKIFTLSTEDFEAINNISKEKGEKRVVHPNWSPFEVFK

SEQ ID NO: 25538 - protein, 453 aa, Saccharomyces cerevisiae; identical to SEQ ID NO: 784

SEQ ID NO: 25539 - protein, 800 aa, Saccharomyces cerevisiae
MASVPKRHTYGGNVVTDRDRHSLQRNNEILHPIHKNQRKHATFGPYIIGSTLGEGEFGKVKLGWTKASSSNEVPKQVAIKLIRRDTIKKDADKEIKIYREINALKHLTHPNIIYLEEVLQNSKYIGIVLEFVSGGEFYKYIQRKRRLKESSACRLFAQLISGVNYMHYKGLVHRDLKLENLLLDKHENLVITDFGFVNEFFEDNELMKTSCGSPCYAAPELVVSTKAYEARKADVWSCGVILYAMLAGYLPWDDDHENPTGDDIARLYKYITQTPLKFPEYITPIPRDLLRRILVPNPRRRINLQTIKRHVWLKPHEAFLSIQPNYWDEHLQKERPKPPNKGDVGRHSTYSSSASSYSKSRDRNSLIIESTLEQHRMSPQLATSRPASPTFSTGSKVVLNDTKNDMKESNINGERTSASCRYTRDSKGNGQTQIEQVSARHSSRGNKHTSVAGLVTIPGSPTTARTRNAPSSKLTEHVKDSSQTSFTQEEFHRIGNYHVPRSRPRPTSYYPGLSRNTADNSLADIPVNKLGSNGRLTDAKDPVPLNAIHDTNKATISNNSIMLLSEGPAAKTSPVDYHYAIGDLNHGDKPITEVIDKINKDLTHKAAENGFPRESIDPESTSTILVTKEPTNSTDEDHVESQLENVGHSSNKSDASSDKDSKKIYEKKRFSFMSLYSSLNGSRSTVESRTSKGNAPPVSSRNPSGQSNRSNIKITQQQPRNLSDRVPNPDKKINDNRIRDNAPSYAESENPGRSVRASVMVSTLREENRSELSNEGNNVEAQTSTARKVLNFFKRRSMRV

SEQ ID NO: 25540 - protein, 437 aa, Saccharomyces cerevisiae
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 25541 - protein, 325 aa, Saccharomyces cerevisiae
MARLPLKQFLADNPKKVLVLDGGQGTELENRGIKVANPVWSTIPFISESFWSDESSANRKIVKEMFNDFLNAGAEILMTTTYQTSYKSVSENTPIRTLSEYNNLLNRIVDFSRNCIGEDKYLIGCIGPWGAHICREFTGDYGAEPENIDFYQYFKPQLENFNKNDKLDLIGFETIPNIHELKAILSWDESILSRPFYIGLSVHEHGVLRDGTTMEEIAQVIKDLGDKINPNFSFLGINCVSFNQSPDILESLHQALPNMALLAYPNSGEVYDTEKKIWLPNSDKLNSWDTVVKQYISSGARIIGGCCRTSPKDIQEISAAVKKYT

SEQ ID NO: 25542 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDTASTYQEEVDPKRLRSDSKLWIAIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHADIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 25543 - protein, 523 aa, Saccharomyces cerevisiae
MDPFHNGNKRSSISFGSSQRQPYNKNNYLSGTNGPSSAAQDQGRGPSPFGMSGNTTNGGNSKRNSGCDLSATYYASRSPMYSPLDFSPPVFSPNHSQLQQARGYAANIPVVSNLMNPSMASVCEYQSHYPLFGLDWSADDYVCLGSYKEDSRNKLQVLHSNDLLSWESVVDADVVYPVSKIQWVPSQLYPRKLATCSDSLRIWSVSPEERQFQEQINLSLCKYNRQHPANPAAADDMKVIGTFPPITSFDWNTVDTNLIISSSIDTTCIVWDLQSSHYVKTQLIAHDSEVFDVRFLTKSTQLFASCGGDGSVRVFDLRSLAHSTIIYEPPSSSVSGATAGTITPSSKGSDALLRLEPSPYDPNVLATFAADSNKIIILDMRNPESPILNLQGHGSSVNGIKWHPTKRNVLLSCGDDCQVLYWDLNSSFMEINAAGSKSPSIHGTSLEDPDGDTEMTDGGAGSGLNEDPLSLNNNSKQVCKTLETPNMMYANKTQEINNIAWRPQRGDWFGCVSGKKFQNVRVL

SEQ ID NO: 25544 - protein, 208 aa, Saccharomyces cerevisiae; identical to SEQ ID NO: 858

SEQ ID NO: 25545 - protein, 865 aa, Saccharomyces cerevisiae
MSYTNKRHTYYGGFTNDLSDTFQYPQRTDEQRRKHVTFGPYILGSTLGEGEFGKVKLGWPKNFSNSSNSTFDFPKQVAIKLIKRDSISNDYRKEVKIYREINALKHLSHPNIVKLEEVLQNSRYIGIVLEYACGGEFYKYIQKKRRLKEMNACRLFSQLISGVHYIHSKGLVHRDLKLENLLLDKNENLVITDFGFVNEFCSRNELMKTSCGSPCYAAPELVISAEPYEARKADIWSCGVILYAILAGYLPWDDDPNNPEGSDIGRLYNYINSTPLKFPDYILPIPRDLLRRMLVSDPKKRINLKQIKKHEWLKPHSSFLSITPDEWDKLNNTQSVFRLAKPRRRYGSRPQSSCSTSSLGSRSDKRDSLVIDSTLITFPAPPQESQNHIITRPASIASDQRLSPIRRSNRHNRSNSAASVALQAVVNADREYVLSHEQSLSPVQNIRQTTGNMTASLSPPPAISPGDIIIETTPIKRNTISGSSIVPSLEEESSTTMQTSKIQPNNMASSQNHQYNKNKTQNSLQSAKNFYRTSSSSHTKPRPTSYHPGSYTTPPYNSNTLSIYEINEKAKSSASSQTLNQRDTSPFDSTPYLALDTCITSSSSIESSPKLITHGQFSVAKPSVDLQSVSGDLIKYKRDADVVTRIYDEKYKQKRKSLRYSGIFSDISCDTVTEESDELRPPESPLQQHEGQESIDKAKTEDTSEKGSKSSNIAKATAQKHVNNHLERSLNEAESTKKRFSFLSLYSYDTSKSSLYSSMDSKRKPSPPSQRRPKKDDSYQTNSKNHYITASNMQTSHQVSKDLPAPTMVQNKCTLETKKAVRSNRSSIMVSEVNKASVDNKAAQSPEHSTAKRVLGFFKRRSMKI

SEQ ID NO: 25546 - protein, 297 aa, Saccharomyces cerevisiae
MAFQKDAKSSAYSSRFQTPFRRRREGKTDYYQRKRLVTQHKAKYNTPKYRLVVRFTNKDIICQIISSTITGDVVLAAAYSHELPRYGITHGLTNWAAAYATGLLIARRTLQKLGLDETYKGVEEVEGEYELTEAVEDGPRPFKVFLDIGLQRTTTGARVFGALKGASDGGLYVPHSENRFPGWDFETEEIDPELLRSYIFGGHVSQYMEELADDDEERFSELFKGYLADDIDADSLEDIYTSAHEAIRADPAFKPTEKKFTKEQYAAESKKYRQTKLSKEERAARVAAKIAALAGQQ

SEQ ID NO: 25547 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 25548 - protein, 93 aa, Saccharomyces cerevisiae
MVTPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 25549 - protein, 388 aa, Saccharomyces cerevisiae
MNCTLTDNTRAINVASNLGAPQQRTIFAKERISIPGYYEIIQFLGKGAYGTVCSVKFKGRSPAARIAVKKISNIFNKEILLKRAIRELKFMNFFKGHKNIVNLIDLEIVTSSPYDGLYCYQELIDYDLAKVIHSSVQLSEFHIKYFLYQILCGLKYIHSADVIHRDLKPGNILCTLNGCLKICDFGLARGIHAGFFKCHSTVQPHITNYVATRWYRAPELLLSNQPYSKSVDIWAVGCILAEFYARKPVFMGRDSMHQIFEIIKVLGTPDKDILIKFGTIKAWNLGKNSNNPVYKKIPWSNIFPFASHEAINLIESLLHWDSTHRLNVEQAISHPFLNEVRKPDDEPVCLQGPFDFTYESELNSMSKLRDYLVEEVKNFKTDLSSSSL

SEQ ID NO: 25550 - protein, 491 aa, Saccharomyces cerevisiae
MSNPIENTENSQNTSSSRFLRNVQRLALNNVTNTTFQKSNANNPALTNFKSTLNSVKKEGSRIPQFTRESVSRSTAAQEEKRTLKENGIQLPKNNLLDDKENQDPSSQQFGALTSIKEGRAELPANISLQESSSAKEIIQHDPLKGVGSSTEVVHNSVENEKLHPARSQLQVRNTESETDSGKKRPISTIVEQELPKKFKVCDENGKEEYEWEDLDAEDVNDPFMVSEYVNDIFEYLHQLEVITLPKKEDLYQHRNIHQNRDILVNWLVKIHNKFGLLPETLYLAINIMDRFLGKELVQLDKLQLVGTSCLFIASKYEEVYSPSIKHFASETDGACTEDEIKEGEKFILKTLKFNLNYPNPMNFLRRISKADDYDIQSRTLAKFLLEISLVDFRFIGILPSLCAAAAMFMSRKMLGKGKWDGNLIHYSGGYTKEELAPVCHMIMDYLVSPIVHDEFHRKYQSRRFMKASIISVQWALKVRKNGYDIMTLHE

SEQ ID NO: 25551 - protein, 435 aa, Saccharomyces cerevisiae
MGENHDHEQSIKRNSMIYNENERQLCNSNLKILQNKRALSKNDSSSKQQVQDSKPRRALTDVPVNNNPLSQNKRIVAGSKAAKVRREENIRPIVSAVQKRQIYNDRTAAEQEEEEEEEGEDDDAASIVNKKRRIDAEGVSEIVGWQDLDYVEKDDTAMVAEYSAEIFAFLYRRELETLPSHNYLLDKTSKYYLRPSMRTILVDWLVEVHEKFQCYPETLFLSINLMDRFLAKNKVTMNKLQLLAVTSLFIAAKFEEVNLPKLAEYAYITDGAASKNDIKNAEMFMLTSLEFNIGWPNPLNFLRRISKADDYDPVNRNIGKFILEYAYCCHQFIHLPPSTVSAMAMYIARRMTNRNKNELWNGTLQHYSGGIDPIHDEAFQSLCIDLVKDIASSKTHLDSLILKYKKPRYGSVYFQTFKWCTSEMHSNFQNLFNLK

SEQ ID NO: 25552 - protein, 462 aa, Homo sapiens
EGKGPAPSARPESGPRGGCASRPRPLRPGSEQQQEERQRPGVGRGWGGGTGRREGAGAGRGPRRIKMAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 25553 - protein, 580 aa, Homo sapiens
KRGARRGGWKRKMPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAACWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 25554 - protein, 96 aa, Gallus gallus
MSGRGKQGGKVRAKAKSRSSRAGLQFPVGRVHRLLRKGNYAERVGAGAPVYMAAVLEYLTAEILELAGNAARDNKKTRIIPRHLQLAIRNDEEHEF

SEQ ID NO: 25555 - protein, 63 aa, Gallus gallus
MSGRGKQGGKARAKAKSRSSRAGLQFPVGRVHRLLRKGNYAERVGAGAPVYLAAVLEYLTAEI

SEQ ID NO: 25556 - protein, 102 aa, Gallus gallus
MSGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGKVT

SEQ ID NO: 25557 - protein, 129 aa, Gallus gallus
MSGRGKQGGKARAKAKSRSSRAGLQFPVGRVHRLLRKGNYAERVGAGAPLYLAAVLEYLTAEILELAGNAARDNKKTRIIPRHLQLAIRNDEELNKLLGKVTIAQGGVLPNIQAVLLPKKTDSHKAKAK

SEQ ID NO: 25558 - protein, 603 aa, Gallus gallus
MANSGACKVLVEDTSSTKAAKPAEKKTKKPKTTLPPVLSTESSEATVKKKPAPKTPPKAATPPQITQFPEDRKVRAGESVELFAKVVGTAPITCTWMKFRKQIQENEYIKIENAENSSKLTISSTKQEHCGCYTLVVENKLGSRQAQVNLTVVDKPDPPAGTPCASDIRSSSLTLSWYGSSYDGGSAVQSYTVEIWNSVDNKWTDLTTCRSTSFNVQDLQADREYKFRVRAANVYGISEPSQESEVVKVGEKQEEELKEEEAELSDDEGKETEVNYRTVTINTEQKVSDVYNIEERLGSGKFGQVFRLVEKKTGKVWAGKFFKAYSAKEKENIRDEISIMNCLHHPKLVQCVDAFEEKANIVMVLEMVSGGELFERIIDEDFELTERECIKYMRQISEGVEYIHKQGIVHLDLKPENIMCVNKTGTSIKLIDFGLARRLESAGSLKVLFGTPEFVAPEVINYEPIGYETDMWSIGVICYILVSGLSPFMGDNDNETLANVTSATWDFDDEAFDEISDDAKDFISNLLKKDMKSRLNCTQCLQHPWLQKDTKNMEAKKLSKDRMKKYMARRKWQKTGHAVRAIGRLSSMAMISGMSGRKASGSS

SEQ ID NO: 25559 - protein, 253 aa, Streptomyces exfoliatus
NDLSGKTVIITGGARGLGAEAARQAVAAGARVVLADVLDEEGAATARELGDAARYQHLDVTIEEDWQRVVAYAREEFGSVDGLVNNAGISTGMFLETESVERFRKVVEINLTGVFIGMKTVIPAMKDAGGGSIVNISSAAGLMGLALTSSYGASKWGVRGLSKLAAVELGTDRIRVNSVHPGMTYTPMTAETGIRQGEGNYPNTPMGRVGEPGEIAGAVVKLLSDTSSYVTGAELAVDGGWTTGPTVKYVMGQ

SEQ ID NO: 25560 - protein, 625 aa, Musa acuminata
MDGCDCIEPQWPADELLIKYQYISDFFIALAYFSIPLELIYFVKKSSFFPYRWVLIQFGAFIVLCGATHLINLWTFALHSRTLAIVMTVAKVSTAVVSCATALMLVHIIPDLLSVKTRELFLKNKAEELDREMGLIRTQEETEGNVRMLTHEIRSTLDRDTVLKTTLVELGRTLDLKDCMLWMPSHSGTSLQLSHTLHHQIPTGSAVPINLPVVNQIFSSNHAMIIPHTCRLARIWPLSVRHVPPEVAAVRVPLLHLSNFQISDWSELSTKSYAVMVLILPSDSGRKWHVHELELVEVVADQVAVALSHAAILAESMRARDLLTEQNVALYLARQEAELAIRARNDFLAVMNHEMQTPLHATITLSSLLLETELSPEQRSMVETVLKSSSLLATLINDILDLSRLEDGRLELEIGDFNLHSVFREVMNFIKPIRAVKKLQVSLMLSPDLPLYAIGDEKRLMQIMLNVAANAVRFTKEGDISLTASVARTDYLREFRALDFYPVASDGHFYLRVTIKDTGCGISHQDLPNLFTKFSQSQNVSSQGYSGNGLGLAICERYVSLMQGHIWVESDGIGKGCTATFVVRLRLCENPDGSQQKILPLPWKKQTQKFSSSRGMPTDPGGLFD

SEQ ID NO: 25561 - protein, 255 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNAQTNWSMEYSRLKAKIELLERNQRHYLGEELEPMSLKDLQNLEQQLETALKHIRSRKNQLMNESLNHLQRKEKEIQEENSMLTKQIKERENILKTKQTQCEQLNRSVDDVPQPQPFQHPHLYMIAHQTSPFLNMGGLYQGEDQTAMRRNNLDLTLEPIYNYLGCYAA

SEQ ID NO: 25562 - protein, 474 aa, Torulaspora delbrueckii
MINFSLLTSIVLLASKVVGVSPSYNGLGLTPQMGWNNWNTFACNVSEDLLLSTVDRIAALGLRDIGYHYVILDDCWSDGRDSDGMLVPDSTKFPNGMKHVADYLHGKDFLFGMYSSAGEYTCAGYAGSLDHEEDDAAFFAKNEVDYLKYDNCYNRGQFGTPETSFNRYRAMSEALNKTERPIFYSLCNWGQDLTFYWGSGIANSWRISGDITAEFDRPDSRCPCDGDEYDCPYAGFHCSIMNILNKAAPMGQNAGVGGWNDLDCLEVGVGNLTDDEEKAHFSMWAIVKSAMVIGADVRNLKPSSFSIYSQASVLAINQDPAGAPAIRVWRRYVPETDQHGQGEVQLWSGPLDNGDRVVALLNGGAKERPMVAYLEDIFIDSFVGSEELSSTWNVYDLWANRIDDSTASQILVGNRTANGLLYNATQLSYADGLKANDTRLFGEKVGTIEPYGLLNVTVPAHGVGLFRLRRESRK

SEQ ID NO: 25563 - protein, 501 aa, Vitis vinifera
MAVPGGHRQRGRPRALIGEPVRPRVPLRRLLRVASVACGIQFGWALQLSLLTPYVQELGIPHAWSSIIWLCGPLSGLLVQPLVGHLSDRCNSRFGRRRPFIVAGATSIVVAVLIIGFSADIGGLLGDGADRRPRAVATFVVGFWLLDVANNVTQGPCRALLADLTEKDHRRTRVANAYFSLFIAVGNVLGFATGSYSGWFRIFWFTSTSSCNADCANLKSAFLLDIIFIAITTYISITAAQELPLSSSSRSTHISEEMAESTHAQEAFLWELFGTLRYLSGSIWIILFVTALTWIGLLPFLLFDTDWMGREIYGGKPNEGQNYNTGVRMGALGLMLNSVVLGITSVLMEKLCRKWGAGFVWGLSNILMSLCFLLMLILSAVVKHMDFLGHDLPPSGVVIAALIVFSILGIPLAITYSVPYALISTRIESLGLGQGLSMGVLNLAIVIPQVIVSLGSGPWDQLFGGGNSPSLAVAAVAAFASGLVAILAIPRSSADKSRVHT

SEQ ID NO: 25564 - protein, 612 aa, Vitis vinifera
MPETMDAPSIRVPYKNLKQAEVELVAADEPRHGADLNSRVPNGTSDPSSSPSSIPHPPKHGGLRTLILSCMIAAGVQFGWALQLSLLTPYIQTLGIEHAFSSFIWLCGPITGLVVQPCVGIWSDKCSSKYGRRRPFILAGSLMISVAVTIIGFSADIGYLLGDTNMDCRKFKGTRTWAAIIFVLGFWMLDLANNTVQGPARALLADLSGPDQRNSANAIFCSWMAVGNILGFSAGASGHWHRWFPFLLNKACCEACGNLKAAFLIAVVFLTLCTLVTLYFAEEVPLMAYQPHHLSDSAPLLDNPQQIGFDNSKSKLDMSAVDNATGNNPESSYEINKNAKHLTPIVQEQNESFSDGPGAVLVNLLTSLRHLPPAMHSVLLVMALSWLSWFPFFLFDTDWMGREVYHGDPKGDESAVKAYDAGVREGAFGLLLNSVDLGISSFLIEPMCQRMGARLVWAMSNFIVFACMAGTAIISLVSVNEYITEGIQHAIGENRAIKIASLVVFALLGFPLSITYSVPFSITAELTADTGGGQGLAIGVLNLAIVIPQMIVSLGAGPWDALFGGGNIPAFVLAALFALAAGVIATLKLPNLSSSSYKSSGFHFGNFPASMR

SEQ ID NO: 25565 - protein, 505 aa, Vitis vinifera
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALNGVLALTMLPAPPPDVPNTKDERTQPSS

SEQ ID NO: 25566 - protein, 424 aa, Mus musculus
MSSFTKDEFDCHILDEGFTAKDILDQKINEVSSSDDKDAFYVADLGDILKKHLRWLKALPRVTPFYAVKCNDSRAIVSTLAAIGTGFDCASKTEIQLVQGLGVPAERVIYANPCKQVSQIKYAASNGVQMMTFDSEIELMKVARAHPKAKLVLRIATDDSKAVCRLSVKFGATLKTSRLLLERAKELNIDVIGVSFHVGSGCTDPDTFVQAVSDARCVFDMATEVGFSMHLLDIGGGFPGSEDTKLKFEEITSVINPALDKYFPSDSGVRIIAEPGRYYVASAFTLAVNIIAKKTVWKEQPGSDDEDESNEQTFMYYVNDGVYGSFNCILYDHAHVKALLQKRPKPDEKYYSSSIWGPTCDGLDRIVERCNLPEMHVGDWMLFENMGAYTVAAASTFNGFQRPNIYYVMSRPMWQLMKQIQSHG

SEQ ID NO: 25567 - protein, 273 aa, Homo sapiens [sequence omitted]

SEQ ID NO: 25568 - protein, 93 aa, Saccharomyces cerevisiae
  unsure (1)..(93): unsure at all Xaa locations
XVTPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 25569 - protein, 327 aa, Pisum sativum
MVLLSKPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQDHNFSLYGEDIHKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKSVRHRVLANGIDPRLSMIYFCGPPLSEKIAPLPSLMKGKESLYKEFTWFEYKSSTYGSRLADNRLGNYERIAAT

SEQ ID NO: 25570 - protein, 330 aa, Antirrhinum majus
MSLSCSDCFSDLLCGEDSNIIFSGGGDDLPEYTSDVESIPTDVDESIAGLLEDERDLAGVNSSSSNQSVDSSTRTESTAWILKVQRYYGFQPLTAYLAVSYFDRFLNAHHLPKLNGWPMQLLSVACLSLAAKMEESLVPSLLDLQVEGANFIFEPRNIQRMELLVLRVLDWRLRSISPFCYLSFFALKIDPTGTYTGFLTSRAKEIILSTVQETSLIEYRPSCIAAATMLSSANDLPKFSFITAQHAEAWCDGLHKDNIASCIKLIQGVESNNRPKKQPKVLPQLRVMTRASLASSESSSSTSSSPSYKRRKLNNSSRADDDKESSDYGV

SEQ ID NO: 25571 - protein, 1218 aa, Klebsiella pneumoniae
MISRMIIVLAMILLTGQTVAATTEPITLTLSSKKRNFISKLPLSQEDLAWLADKRTMTIAVYGEENPPIAMNSNNGCYRGINADYLQLLKDALHVNLVLHYYDDEPQALSALNNEEADLVLTSNNTSHQATTPFIISQLLFQAYPTLVTLNSNGMMPFYQLDKTVNVAVSQHYPSDTFIKSIFRHANIVSYSSNYQALASVAKSENDYFIGDNIASNFLIARDFYQKLDIVKYWRSPLTGSYFIARENQSRLVAIINKFISALDASTHIRISHTWVDDGNLTFLTKPLSLTPKEKRWIEKNPVLRTLVNPYYAPFTVLDENREIRGLVGDILNLVQLQTGLHFQPVIAKSNSDMAEIMRKGDWDMVPTVTYSPEREDEMAFTQPFFSTPYVVVSRTENKQKDIFQAGSTVAIPAYYSLRDKLIQKYPDVHWIIVENTSTALSSLNLGKVDSVVTTQLAARYIIDHYYPETMSYQRIPNQPSAQIAFAVPRDKPELQSILNKALAEIPPKETLSLAGKWIKMPEVKIDTWDLYSRPFYILTVSAVLLILSSLLWGGYLLRAIRREKASQAALEYQLSLRQTLSNSIPVPVYITTPEGEIESYNRAFNAFFTPQQREAIHYSLFDRRSPLVHIFPVIQQEMQQGLAPETVASHQFTLNNGAEDRTILHWMTLCPLPVPLPPVLICGWQDITESRKLMEALQVEKDKAIEASRAKSRFLARMSHEIRTPVSAIMGFLELLATGPQSEREAQESLQLAYATAQSLIGLIGDVLDMEKIESGNFELTPEWVDIEALTQATMANFAGLARQKNLQLTVSYQLNAGGILFLDPQAIKQVLANFLSNAIKFTVSGGVEIKVETQPRENDAAQLMLSVKDSGVGISEEEQQLLFKPFSQASCGKKQMGSGLGLTICKELMDRMHGTISVASHPGTGTTMSIYVQTQVSDRAPADLNNQEMALPVSSGLRVIIADDNPTNRLLLRRQLDILGYYVDDVEDGEQAFSLIKRRQYDLLITDLNMPGMDGLTLAQQVRKINPALVIWGLTANAQPDEKARCLASGMDLCLIKPVNLPQLAAAFNSITQRLENPTQTEISSSLNTQLDTTVCNELIDMQALRANALDDTAFMLELINQAYHENVKDLAALKKAMFIHDRDIAYIIYIELMVLAQLIGATSLHVLADKLENALASEQPLSLFGEDMQLLEQQLIALGKAMDNFLKREGLTSRE

SEQ ID NO: 25572 - protein, 354 aa, Ustilago maydis
MSHAHGQQPNHSTTFKVGETYKVVDVVGEGAYGVVCSAIHVPSSSRVAIKKITPFDHSMFCLRTLREIKLLRHFNHENIISILDIVKPDDYDSFSEVYLIQELMETDMHRVIRTQELSDDHCQYFIYQTLRGLKALHSAQVLHRDLKPSNLLLNANCDLKICDFGLARSANQPEAEGTGFMTEYVATRWYRAPEIMLTFKEYTKAIDVWSVGCILAEMLAGKPLFPGRDYHHQLSLTLEILGTPSLDDFYAITSTRSRDYIRALPFRKRRNLSLMFPNANPLAVDLMEKCLTFSPRKRITVEEALAHPYLEPYHDPEDEPTAEPLDPSFFDFDYCKEQLSRSELKRLIYNEIMR

SEQ ID NO: 25573 - protein, 357 aa, Magnaporthe grisea
MAEFVRAQIFGTTFEITSRYSDLQPVGMGAFGLVCSARDQLTNQNVAIKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALAHEYLTPYHDPTDEPIAEEKFDWSFNDADLPVDTWKIMMYSEILDYHNAEAGMQQMDDQFTGQ

SEQ ID NO: 25574 - protein, 301 aa, Arabidopsis thaliana; identical to SEQ ID NO: 765

SEQ ID NO: 25575 - protein, 320 aa, Synechococcus sp. PCC 7942
MAKTETPTSDLVRTYLREIGRVPLLTHEEEVVLGKRVQQWMKLQELRQTLQSEEGDRDPSDLEWAAAAGLSIEELRQQQHLGEQAKRKMIEANLRLVVSVAKKYLKRNMDLLDLIQEGTIGMQRGVEKFDPTKGYRFSTYAYWWIRQAITRAIAEKARTIRLPIHITEKLNKIKKMQRQLSQQLSTATLPELAAALDLTPAQVRDYLEKARHPLSLDLRVGDNQDTELGDLLETDMQRRRKEFTLQASMRRDIDRLLDQLTEQQRQVIALRYGLEDGQVMTLASIGDRLQISRERVRQLEREALHTLRQARSQVQEYLAS

SEQ ID NO: 25576 - protein, 311 aa, Synechococcus sp. PCC 7942
MNVQERRNLNAAVERHTSDHVSWYLSSIGRIPLLTAEEEVELSRKVQLMMALLENPDAESNSENQAVLQAGQRAKTKMLKANLRLVVSVAKKCQNQGLELLDLIQEGSLGLERAVEKFDPALGYKFSTYAYWWIRQSMTRAIDNHARTIRLPIHVSEKISRIKKMTRELTHQLKRLPSRAEIAEALKLPLQDVEMLLSQSTPCTSLDAQARGDDGRSFLGDLIPDPKSLEPMDAMDRHIQHEQISTWLAHLTEREQQVLQLRFGLHDGEQHTLAEIGRRLNVSRERIRQVEARALQKLRVLSQQPLCPEAC

SEQ ID NO: 25577 - protein, 356 aa, Emericella nidulans
MGSCFSSESAGDVEQKKRSQAIDRKLEEDSRRLRRECKILLLGSGESGKSTIVKQMKIIHQNGYTVEELALYRLTVYKNLLECAKALIGAYHQFNLEPTSQKVRDNIEFLANYNIDPDPNIPLDPAVGDAITYIWNDPCTSTALERQNEFYLMDSAPYFFEEAKRITSPDYIPNVNDVLRARTKTTGIYETRFTMGQLSIHMFDVGGQRSERKKWIHCFENVTSIIFCVALSEYDQVLLEEGNQNRMMESLVLFDSVVNSRWFMRTSIILFLNKVDLFRQKLPRSPLSNYFPDYSGGNDVNRAAKYLLWRFNQVNRAHLNLYPHLTQATDTTNIRLVFAAVKETILQNALKDSGIL

SEQ ID NO: 25578 - protein, 526 aa, Lentinula edodes
MLPFVYLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADCTELIAAAVAPLADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVSCTYVVHPKQTTIRFVTDNPGPWFLHCHIDLHLEFGLAVVMAEAPSLVKATDVTTPAWDELCPIYDSLTPAQLP

SEQ ID NO: 25579 - protein, 526 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADCTELIAAAVAPPADATLINGKGRYLGGPAVPLAVINVQQGKRYRFRMISIACDAYHNFSIDGHRLTVIEVDGENHEPATVDNIQIFPGQRYSFVLTATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYKNPVSCTYVVHPKQTTIRFVTDNPGPWFLHCHIDLHLEFGLAVVMAEAPSLVKATDVTTPAWDELCPIYDSLTPAQLP

SEQ ID NO: 25580 - protein, 518 aa, Pycnoporus cinnabarinus
MSRFQSLFFFVLVSLTAVANAAIGPVADLTLTNAQVSPDGFAREAVVVNGITPAPLITGNKGDRFQLNVIDQLTNHTMLKTSSIHWHGFFQQGTNWADGPAFVNQCPIASGHSFLYDFQVPDQAGTFWYHSHLSTQYCDGLRGPFVVYDPNDPHASLYDIDNDDTVITLADWYHVAAKLGPRFPFGSDSTLINGLGRTTGIAPSDLAVIKVTQGKRYRFRLVSLSCDPNHTFSIDNHTMTIIEADSINTQPLEVDSIQIFAAQRYSFVLDASQPVDNYWIRANPAFGNTGFAGGINSAILRYDGAPEIEPTSVQTTPTKPLNEVDLHPLSPMPVPGSPEPGGVDKPLNLVFNFNGTNFFINDHTFVPPSVPVLLQILSGAQAAQDLVPEGSVFVLPSNSSIEISFPATANAPGFPHPFHLHGHAFAVVRSAGSSVYNYDNPIFRDVVSTGQPGDNVTIRFETNNPGPWFLHCHIDFHLDAGFAVVMAEDTPDTKAANPVPQAWSDLCPIYDALDPSDL

SEQ ID NO: 25581 - protein, 529 aa, Pneumocystis carinii
MGEDSYLCLSEEIKKKLEEYSEKDGYDLDSLICSRRHGGLTYNDIIILPGYIDFEVNSVSLESHITKKIVLKTPFMSSPMDTVTESDMAINLALLGGIGVIHHNCTIEEQTEMVRKVKKFENGFITSPIVLSLNHRVRDVRRIKEELGFSGIPITDTGQLNGKLLGIVTSRDIQFHNNDESFLSEVMTKDLVTGSEGIRLEEANEILRSCKKGKLPIVDKEGNLTALLSRSDLMKNLHFPLASKLPDSKQLICAAAVGTRPDDRIRLKHLVEAGLDIVVLDSSQGNSIYQINMIKWIKKEFPNLEVIAGNVVTREQAANLISAGADALRVGMGSGSICITQEIMAVGRPQATAVYAVSEFASKFGVPTIADGGIENIGHITKALALGASAVMMGNLLAGTTESPGQYYYRDGQRLKSYRGMGSIDAMEHLSGKNKGDNAASSRYFGEADTIRVAQGVSGSVIDKGSLHVYVPYLRTGLQHSLQDIGVQNLTELRKQVKEKNIRFEFRTVASQLEGNVHGLDSYQKKLWS

SEQ ID NO: 25582 - protein, 247 aa, Dendrobium grex Madame Thong-IN
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 25583 - protein, 220 aa, Dendrobium grex Madame Thong-IN
MGRGRVELKRIENKINRQVTFAKRRNGLLKKAYELSVLCDAEVALIVFSNRGRLFEFCSSTSMTKTLERYQKCSYNASESAVPSKDAQNSYHEYLTLKAKVEYLQRSQGNLLGEDLIELSSKELDQLELQLEMSLKQIRSTKTQLMLDQLCDIKRKEQMLHEANRALSMKLKEDGPEIPLELSWPGGETNGSSERQQPQSDKFFQPLPCSNPSLQIGYSP

SEQ ID NO: 25584 - protein, 244 aa, Gnetum gnemon
  unsure (1)..(244): unsure at all Xaa locations
MVRGKTQMKRIENATSRQVTFSKRRNGLLKKAYELSILCDAEVGLIIFSPRGKLYEFANPSMQKMLDRYQKCCQESTANTSKNLVEDTQHLKREVAIMEEKIKMLEYAQKKLLGENLESLSMKELTQLENQAERGLVNIRARKTEILMDQINQLKRKSQLLGEENAVLRKKCNGPYMGGGLLSILHAGASGAGPXNNNNNNGGSGVTHHDDNNNNNRSNNVNVEDVETQLNIGPPDVHCSINQC

SEQ ID NO: 25585 - protein, 492 aa, Cicer arietinum
LHQVIKANDDLSREHHQFFLYQMLRALKYMHSANVYHRDLKPKNILANSNCKLKVCDFGLARVAFNDAPTSIFWTDYVATRWYRAPELCGSFSSKYTPAIDIWSIGCIFAEVLLGKPLFPGKSVVHQLDLITDLLGTPLPETITGVRNDNARKYLAGMRKKLPVPFEQKFPNADPLALRLLQRLLAFDSKNRPTAEEALADPYFKGLAKVEREPSCKPISKLEFEFERRRITKDDVRELIYREILEYHPQLFKDYMNGTEGANFLYPSAIDQLRKQFAYLEENDGKSGSVLPPERKHVSLPRSTVYSGSILPSNQRTPALYEKKKMVEETSKSWGAAGENSRNQLRGVQPPPRVPAKPGRVVGPVLHYEDERITKSSNDPRIVIQNTTQAVSSRDAFQTHPPNTKTTSGIHKEQGKNEFPSLQSNLHATATTDLNNNPYRRRVINNNLNDPVTTIDAKMLQAQSHLGVVGAAAVAVATHSHRYSRGIQYGLF

SEQ ID NO: 25586 - protein, 433 aa, Mucor circinelloides f. lusitanicus
MLTDLETVVINPPYNVGALFKSAPSSPDISVHNRSVSEVFQQRLESITNQKWESDQENAFFVGDLGEVVRQHIRWKSLLPRIEPFYAIKCNPDPMVVQLLASLGCGFDCASKQEIQQVLDVGVDPSRIIYANPCKQASFIRYSAQQNVSRMTFDNAEELFKIKKYYPDAELVLRILTDDSMSLCQLGLKFGAPLHTVQHLLQLAKELNLNVIGVSFHVGSGCLDENAFGDAVVRAKNVFDQAKAMGYDFKFLDVGGGFPGADVKNGITFEKVAAVLGPIVDRLFPKDVRVIAEPGRYYVASAFNLAVNVIGRRTNMAHQDQTDASPEYMYYVNDGMYGSVNCIIFDHQVVHPKVLMKNELFAYGQDLPEAQYESSVWGPTCDSIDCLNKSARLPKLEPGDWLYFENMGAHTICAASQFNGFRKSEVLYTNTFC

SEQ ID NO: 25587 - protein, 241 aa, Saccharum officinarum
GIRHEVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFVNPTDHNKPVQEVLAEMTNGGVDRSVECTGNINAMIQAFECVHDGWGVAVLVGVPHKDAEFKTHPMNLLNERTLKGTFFGNYKPRTDLPNVVELYMKKELEVEKFITHSVSFAEINKAFDLMAKGEGIRCIIRMEN

SEQ ID NO: 25588 - protein, 158 aa, Saccharum officinarum
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKVPLTINGQPIFHFVGTFTFTSTPSFMSL

SEQ ID NO: 25589 - protein, 623 aa, Arabidopsis thaliana
MEAVIQTRGLLSLPTKPIGVRSQLQPSHGLKQRLFAAKPRNLHGCLYPLTGTRNFKPLSQPCMGFRFPTKREAPSSYARRRRGCWRRSCLRRSDSAAVVASRKIFGVEVATLKKIIPLGLMFFCILFNYTILRDTKDVLVVTAKGSSAEIIPFLKTWVNLPMAIGFMLLYTKLSNVLSKKALFYTVIVPFIIYFGGFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 25590 - protein, 254 aa, Brassica rapa subsp. pekinensis
MGRGRVEMKRIENKINRQVTFSKRRAGLLKKAHEISILCDAEVSLIVFSHKGKLFEYSSESCMEKVLERYERYSYAEKQLKAPDSHVNAQTNWSMEYSRLKAKIELLERNQRHYLGEDLESISIKELQNLEQQLDTSLKHIRSRKNQLMHESLNHLQRKEKEILEENSMLTKQIKERESILRTHQNQSEQQNRSHHVAPQPQPQLNPYMISHQASPFLSMGGMYQGEDPTAVRRNRLDLTLEPIYNCNLGYFAA

SEQ ID NO: 25591 - protein, 324 aa, Eufolliculina uhligi
EAKYDYWEKLWTLIEEAPRILICEANNVGSKQLQDLRRVLRNKATILFGKNTLIRAGLKHRLTEPNAEDEDFEKRKNTWTPKPELEHLIPLLRGNVCLIFCHAEMGEVLSAVEESKVPAEAKAGTIAPNDVHVYPGPTGMDPSQTSFFQALGIFTKIVKGQIDIVNELHLIFKDKKVGNSEAVLLKKLGVKPFSFGLKVKNVYDNGSVYSAEVLKLTNDILLGKFMNGVRNIAAMSLTLGIPTAASAPHSIVSGFKNLVSIAHVVDYTFSQAEGLLAVLKDPSKLAAIQSAPGAAKAAEPAKEAEKSEESDADADLGGMFGDDF

SEQ ID NO: 25592 - protein, 687 aa, Drosophila melanogaster
MLLIVGFALCVLAPGCSATDTDIALDAKATLNHRIQSLDLLVFVFLLALTVLTIWLFKHHRVSWLHETGLAVIYGLIVGAIIRYAGTSGTLDHMQVEPQGVPTYSDKLPPDTLWFRYPVNQTNGTKPPEGIKTYAYVFRGQVHDVDENEIDLKATFDPEVFFNIILPPIIFYAGYCLKKKYFFRNLGAILTFAIVGTTLSAFLIGGFMYGCVKLMPKYLSSSFTFLDSLYFGALISPTDPLTILAIFNDLRVDVNLYALVLGESVLNDAVAIVLSGAIQNYGEHYSNTGEFETTAFLRSLSDFFSIFLLSLMIGAAMGCLTALMTKFTRVRDFPLLESALFVLMSYSTFLLAEATELTGVVAVLFCGICQAHYTYNNLSEDSRQRTKQIFELLNFLAENFIFSYIGVSMFTFPKHHFDAGFIITAFICAAIGRAVNVYPLSWLLNIKRKPKISTNFQHMLFFAGLRGAMSFALAIRNTVSDERQTMLTATSLIVIFTVVIQGGAANFLLNWLKIPVGVDDETEQLNNYQVHSSDGYLQDVEGGGVNRNKMRLSGGTDTNLDTPVDGTNGSLGGASGGRRRNSHEKAILARIWGNFDTKYMKPLLTHSRPTLLETLPVCCNPIARLLTTTQQLTQDGSEFRRVDSDSDICIDNDTGNGLSQDGSGAAPGVGRRNSLSRVGGDHRNAYI

SEQ ID NO: 25593 - protein, 356 aa, Nicotiana tabacum
MEFTSLVDTSLDLSFRPLPVLDKVLKQEVQSNFTGLSRDNMLVKDEAGDLLEELNRVSSENKKLTEMLTVVCENYNALRNQLMEYMNNQNNGVVDDSAGSRKRKAENISNPNNNNNNKNNNLDIVCGRLSESSSSDEESCCKKPREEHIKTKVSVVSMRTEASDTSLIVKDGYQWRKYGQKVTRDNPSPRAYFRCSFAPGCPVKKKVQRSIEDQSVVVATYEGEHNHPVNPSKPEAAAGTATSTGSRLNVRTIGGTTASVPCSTTLNSSGPTITLDLTEPTTVAKGDIMKMSSSISPTGGSSQRTTEGDHYSRPEFQQFLIEQMASSLTKDPSFKAALAAAISGKILQHNNQTSRW

SEQ ID NO: 25594 - protein, 132 aa, Schizosaccharomyces pombe
YLIALTVSLLGVQLTWSVELGYGTPYLFSLGLRKEWTSIIWIAGPLTGILIQPIAGILSDRVNSRIGRRRPFMLCASLLGTFSLFLMGWAPDICLFIFSNEVLMKRVTIVLATISIYLLDVAVNVVMASTRS

SEQ ID NO: 25595 - protein, 115 aa, Schizosaccharomyces pombe
PRLHKLHHKWIICTPYASHAFKSADGFLQSLPYHLFPFFFPLHKLTYLALFTFVNFWSIMIHDGKYISNNPIINGAAHHNGHHIYFNYNYGQFTTLFDRLGNSFRAPDEAWFDKD

SEQ ID NO: 25596 - protein, 209 aa, Schizosaccharomyces pombe
KKTFGIQMDNFFALYRRYLLHTVKGYECDWDSIRPLGPEDMIDYGDLPLCKNAGKYLNRLAVVKLNGGMGNALGVNYPKAMIEVRDNQSFLDLSIRQIEYLNRRYDVSVPFILMNSYDTNDETCKVLRKYAGCKIDISTFEQSRYPRVFVDSQLPVPKAAPSPIEEWYPPGHGDIFDALVHSGTIERLLAQGKDYLFVSNIDNLGASVD

SEQ ID NO: 25597 - protein, 199 aa, Schizosaccharomyces pombe
KEEEDIQMKEPLDSQDTGAVSASSVNEGFRADQKSKDGETSDLIKIPRRAYELRFLSRSLMLNFLELLGIMAKAPEQFPSKVENIRVLLLNLHHLINDYRPHQSRESLIMLLEKQLKHEESQVELLRTHNRQMTETLEKYKSLDFNMEKEGDVIQQLKSSIKKPLSGAEDEQKSRSMFSKNDEKLKKSLELMEDVIKRD

SEQ ID NO: 25598 - protein, 52 aa, Schizosaccharomyces pombe
YTKDIQYLLHEPIVQKFREYKVFARKLSKALGKGELETAKRLEARKPTYSLD

SEQ ID NO: 25599 - protein, 254 aa, Pisum sativum
MVLLSKPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQEHNFSLYGEDIDKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKV

SEQ ID NO: 25600 - protein, 327 aa, Pisum sativum
MVLLSKPTSEQYTYVRNNMPITFSSSIPLVDLSKPDAKTLIVKACEDFGFFKVINHGIPLDAISQLESEAFKFFSLPQTEKEKAGPANPFGYGNKRIGLNGDIGWIEYLLLTTNQDHNFSLYGEDIDKFRGLLKDYKCAMRNMACEILDLMAEGLKIQPKNVFSKLVMDKQSDCLFRVNHYPACPELAINGENLIGFGEHTDPQIISILRSNNTSGFQISLRDGSWISVPPDHSSFFINVGDSLQVMTNGRFKSVRHRVLANGIDPRLSMIYFCGPPLSEKIAPLPSLMKGKESLYKEFTWFEYKSSTYGSRLADNRLGNYERIAAT

SEQ ID NO: 25601 - protein, 321 aa, Papaver somniferum
MESNGVPMITLSSGIRMPALGMGTAETMVKGTEREKLAFLKAIEVGYRHFDTAAAYQTEECLGEAIAEALQLGLIKSRDELFITSKLWCADAHADLVLPALQNSLRNLKLDYLDLYLIHHPVSLKPGKFVNEIPKDHILPMDYKSVWAAMEECQTLGFTRAIGVCNFSCKRLQELMETANSPPVVNQVEMSPTLHQKNLREYCKANNIMITAHSVLGAVGAAWGTNAVMHSKVLHQIAVARGKSVAQVSMRWVYQQGASLVVKSFNEARMKENLKIFDWELTAEDMEKISEIPQSRTSSAAFLLSPTGPFKTEEEFWDEKD

SEQ ID NO: 25602 - protein, 321 aa, Papaver somniferum
MESNGVPMITLSSGIRMPALGMGTVETMEKGTEREKLAFLNAIEVGYRHFDTAAAYQSEECLGEAIAEALQLGLIKSRDELFITSKLWCADAHADLVLPALQNSLRNLKLEYLDLYLIHHPVSLKPGKLVNEIPKDHILPMDYKSVWAAMEECQTLGFTRAIGVSNFSCKKLQELMATAKIPPVVNQVEMSPTLHQKNLREYCKANNIMITAHSVLGAIGAPWGSNAVMDSKVLHQIAVARGKSVAQVSMRWVYQQGASLVVKSFNEARMKENLKIFDSELTAEDMEKISEIPQSRTSSADFLLSPTGPFKTEEEFWDEKD

SEQ ID NO: 25603 - protein, 321 aa, Papaver somniferum
MESNGVPMITLSSGIRMPALGMGTAETMVKGTEREKLAFLKAIEVGYRHFDTAAAYQSEECLGEAIAEALQLGLIKSRDELFITSKLWCADAHADLVLPALQNSLRNLKLDYLDLYLIHHPVSLKPGKFVNEIPKDHILPMDYKSVWAAMEECQTLGFTRAIGVCNFSCKKLQELMAAAKIPPVVNQVEMSPTLHQKNLREYCKANNIMITAHSVLGAICAPWGSNAVMDSKVLHQIAVARGKSVAQVSMRWVYQQGASLVVKSFNEGRMKENLKIFDWELTAENMEKISEIPQSRTSSADFLLSPTGPFKTEEEFWDEKD

SEQ ID NO: 25604 - protein, 321 aa, Papaver somniferum
MESNGVPMITLSSGIRMPALGMGTAETMVKGTEREKLAFLKAIEVGYRHFDTAAAYQSEECLGEAIAEALQLGLIKSRDELFITSKLWCADAHADLVLPALQNSLRNLKLEYLDLYLIHHPVSLKPGKFVNEIPKDHILPMDYKSVWAAMEECQTLGFTRAIGVSNFSCKKLQELMAAAKIPPVVNQVEMSPTLHQKNLREYCKANNIMITAHSVLGAIGAPWGSNAVMDSKVLHQIAVARGKSVAQVSMRWVYQQGASLVVKSFNEGRMKENLKIFDWELTAEDMEKISEIPQSRTSSAAFLLSPTGPFKTEEEFWDEKD

SEQ ID NO: 25605 - protein, 321 aa, Papaver somniferum
MEIGGVPVVTLSSGRGMPILGMGTAENNLQGSERVKLAILKAIEVGYRHFDTAFVYQTEGSLGEAVAEALQNGLIKSRDELFITSKLWCADAYPDHVLPALQNSLRNLKLEYLDLYLIHWPVSLKPGKFVHPIPKDEIFPIDYKSVWAAMEKCQMLGLTKSIGVSNFSCKKLHYLMATANIPPAVNQVEMNPIWQQQKLRDYCKTNNIMVTAYSPLGAKGTMWGSSGVMDSEVLNQISQVRGKSVAQVSLRWVYEQGASLLVKSFNEERMKENLKIFDWELSPEDLKNISELPQRRVSTGDPFVSINGPFKSVEELWDDEV

SEQ ID NO: 25606 - protein, 361 aa, Xenopus laevis
MAAAGAASNPGGGPEMVRGQAFDVGPRYINLAYIGEGAYGMVCSAHDNVNKVRVAIKKISPFEHQTYCQRTLREIKILLRFKHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADPKALDLLDKMLTFNPHKRIEVEAALAHPYLEQYYDPSDEPVAEAPFKFEMELDDLPKETLKELIFEETARFQPGY

SEQ ID NO: 25607 - protein, 37 aa, Lycopersicon esculentum
DVPWEMFIDTCKRLRIMKGSDAIGLAPRAMEKCRSRN

SEQ ID NO: 25608 - protein, 369 aa, Oryza sativa; identical to SEQ ID NO: 3244

SEQ ID NO: 25609 - protein, 948 aa, Plasmodium falciparum
MFMINYVFCEESNNMSKMVPDDDNNNYSSGKSCVYYQDLNKKEKEEYYRLNKKLRNDLFINSKQFYELHTFTERTVGFMRVQYFVYKLRDVVKCVEKETLLARSSSCLFMFNNIKRNDVHDDYVTKSSNGGVIKQLTERDVDDMYEYALNFCKQNKIVVVDTNTFFFDASKRKENLIKLEKVQTNEKDEYEEKDEVYRRGNNELSSLDHLDSKNNLIHMYYEKNKCDIINKDDENSTIATNNNDNNNDSSSYDKSITISRSSSCNNSHLSYSSFDNNHGNEKMKDYISVDENNNNNNNNKNNNVLLTLQRNSDDENGKDKDNEKNDVSLENNMEKNYKEEIWNYYTKNKVEVKTLEKVLNENIDTSVVCINLQKILAQYVRFKKNLPHVTPFYSVKSNNDEVVIKFLYGLNCNFDCASIGEISKVIKLLPNLSRDRIIFANTIKSINSLIYARKENINLCTFDNLDELKKIYKYHPKCSLILRINVDFKNYKSYMSSKYGANEYEWEEMLLYAKKHNLNIVGVSFHVGSNTKNLFDFCLAIKLCRDVFDMSSNMGFNFYIINLGGGYPEELEYDNAKKHDKIHYCTLSLQEIKKDIQKFLNEETFLKTKYGYYSFEKISLAINMSIDHYFSHMKDNLRVICEPGRYMVAASSTLAVKIIGKRRPTFQGIMLKDLKAHYDPLNFAQQENKKQDEPKINHNNDNNDNNSNDNNNNNNNNNNNQKGGQGNIMNDLIITSTNDSTNKKNDHSSSQVIQNVSCTIRDKEGDNIKINTHTINNPNINGKENTVDGDNINIAHKNIGNNFSSSNSKLGNITNIKKKVVNINDNRYNYFSYYVSDSIYGCFSGIIFDEYNRCPIYVIKNKNNPNQNFMNFNLYLANVFGQSCDGLDMINSITYLPECYINDWLLYEYAGAYTFVSSSNFNGFKKCKKVYIFPESKPSLKGQPNKHW

SEQ ID NO: 25610 - protein, 370 aa, Mus musculus
MVQASMRSPNMETFKQQKVEDFYDIGEELGSGQFAIVKKCREKSTGLEYAAKFIKKRQSRASRRGVCREEIEREVSILRQVLHPNIITLQDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDTQQAMVRRESVVNLENFKKQYVRRRWKLSFSIVSLCNHLTRSLMKKVHLRTSEDLRNCESDTEENIARRKALHPRRRSSTS

SEQ ID NO: 25611 - protein, 142 aa, Lilium longiflorum
MAEEHHKHHLFHHNKESNPEVVVSETNYITDGLNSTYSTSSDVYGGNQSQANYEDYEKEKKHIKHKEHLGEMATAGAGAFALYEKHEAKKDPEHAHRHKLEEEIAAAAAAGAGGYTFHEHHEKKTLKKENEEVEGKKHHFFG

SEQ ID NO: 25612 - protein, 1320 aa, Emericella nidulans
MGKTSAKDVAELKDYQLGDCLGRGAFGSVYRALNWNTGETVAVKQIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQVGPTLRTPEGSDHAADVHQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHRVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 25613 - protein, 60 aa, Tetrahymena thermophila
MRAILIDWIVEIHRKCKLLPETLFITVNLIDRFLDRATCTRDNLQLVGVTALFIASKYEE

SEQ ID NO: 25614 - protein, 60 aa, Blepharisma intermedium
MRAILIDWIIEVHLKFKLLPETLYLAVNLIDRYLEIVNISTSILQLIGVSALLIASKYEE

SEQ ID NO: 25615 - protein, 60 aa, Sterkiella histriomuscorum
MRAILVDWLIEVHLKFRLQRETLYITVKIIDLYLEKQMVTKSRLQLVGVTSLLIASKYEE

SEQ ID NO: 25616 - protein, 60 aa, Colpoda sp.
MRAILIDCIISVHFKFHLQPETLFLTVNLIDRYLERSQIAKENLPLVGVTALFIASKYEE

SEQ ID NO: 25617 - protein, 514 aa, Aspergillus oryzae
MVHLAQVHRNADLDSTIKRVDSIQLENTDEDGFYSSVYGTRFATEQLPQTEMPEREMPREVAYRMIKDELSLDGNPMLNLASFVTTYMEDEAEKLMTESFSKNFIDYEEYPQSAEIQNRCVNMIARLFNAPVHSEDEHPMGTSTIGSSEAIMLGTLAMKRRWQNKRKAEGKDYSRPNIVMNSAVQVCWEKAARYFDVEERYVYCTEDRYVIDPQQAVDLVDENTIGICAILGTTYTGEYEDVKAINDLLIERNIDVPIHVDAASGGFVAPFINPKLEWDFRLPKVVSINVSGHKYGLVYPGVGWVVWRSPEYLPKDLIFNINYLGAEQASFTLNFSKGASQVIGQYYQMIRLGKRGYRSIMTNITVTADFLAQELEKMGFIIMSQRRGHGLPLVAFRLPAEREGQFDEFALAHQLRERGWIVPAYTMAPNSNNLKLMRVVVREDFTKSRCDALLSDIKLGLKTLGDMDKAMLDKYTQHVRTHATHSHKSKHNHPHYKGETHSLQGKHGKTHGVC

SEQ ID NO: 25618 - protein, 329 aa, Oryza sativa (japonica cultivar-group); identical to SEQ ID NO: 3465

SEQ ID NO: 25619 - protein, 454 aa, Oryza sativa (japonica cultivar-group); identical to SEQ ID NO: 3515

SEQ ID NO: 25620 - protein, 281 aa, Nicotiana tabacum
MVRAPCCEKMGLKKGPWTPEEDQILVSYIQTNGHGNWRALPKLAGLLRCGKSCRLRWTNYLRPDIKRGNFTREEEDSIIQLHEMLGNRWSAIAARLPGRTDNEIKNVWHTHLKKRLKNYQPPQNSKRHSKNNLDSKAPSTSQTFNNSDNFSNIQEDINGPVTGPNSPQRSSSEMSTVTVDSTAMTTITIDDQNMFKQLDEMDSSENFIPEIDESFWTDDLSTSDNSTFGMEGTGGELQVQFPFSSVKQESMDMVGAKLEDDMDFWYNVFIKSGDLLDLPEF

SEQ ID NO: 25621 - protein, 277 aa, Nicotiana tabacum
MGRAPCCEKMGLKKGPWTPEEDQILISFIQQNGHGNWRALPKQAGLLRCGKSCRLRWTNYLRPDIKRGNFTKEEEDTIIQLHEMLGNRWSAIAAKLPGRTDNEIKNVWHTHLKKKLKDYKPPQNPKRHSKNHDSKGPTTSESSNNSHLTFIYTQKHIIDSSVPAPNSPQISSSTEMSTVTLVDDHQMVIKQEEMESSEYFPEIDESFWTDKLSTDNNWSNTHDHVMVTADQELQVQLPFSSLKEENVDMLTTKMEDDMDFWYNVFIKTDDLPELPEF

SEQ ID NO: 25622 - protein, 281 aa, Nicotiana tabacum
MVRAPCCEKMGLKKGPWTPEEDQVLVSYIQTNGHGNWRALPKLAGLLRCGKSCRLRWTNYLRPDIKRGNFTREEEDSIIQLHEMLGNRWSAIAARLPGRTDNEIKNVWHTHLKKRLKNYQPPQNSKKHSKNNLDSKAPSTSQTFNNSDNFSNIQEDINGPVTGPNSPQRSSSEMSTVTADSTAMTTITIDDQNMFKQLDEMNSSESFIPEIDESFWTNDLSTGDNSNFDMEGTGEELQVQFPFSSVKQESMDMVGTKLEDDMDFWYNVFIKSGDLLDLPEF

SEQ ID NO: 25623 - protein, 391 aa, Arabidopsis thaliana
MGRGLMNSLKPYLAMISMQFGYAGMYIITMVSLKHGMNHYVLAVYRHAIATAVIAPFALFHERKIRPKMTFRIFLQIALLGFIEPVLDQNLYYVGMTYTSATFASATANVLPAITFVLAIIFRFKLESVNFKKVRSIAKVVGTVITVSGALLMTLYKGPIVDFIRFGGGGGGGSDGAGGSHGGAGAAAMDKHWIPGTLMLLGRTFGWAGFFILQSFTLKQYPAELSLTTLICLMGTLEGTAVSLVTVRDLSAWKIGFDSNLFAAAYSGVICSGVAYYVQGVVMRERGPVFVATFNPLCVVITAALGVVVLSESIHLGSVIGTLFIIVGLYTVVWGKGKDKRMTDDDEDCKGLPIKSPVKPVDTGKGLAAELEMKSKEGQEAKATTTTQVEI

SEQ ID NO: 25624 - protein, 308 aa, Arabidopsis thaliana
MAIISTRDYVSIPMPQVQSKRRPIFLSSSTPTCNNLSAYHRHITQQQKIERQQIKIDNRQKKPRITGVLKRPYKHTSCSLNSLTLSLIWVKRANKAKPLSSLLHFLSRFSHISPLESLTMASTTCAREVHYRGVRKRPWGRYAAEIRDPWKKTRVWLGTFDTPEEAALAYDGAARFLRGIKAKTNFPSPLSLDLNHLPSAPSAATAAANNQPHQHQQLWFAAPPPVPPSSDHHHQHHRIFLRTGVLNDKTSDYSSTEAPLYFTSSPNTATSSPGYQVVGFPMMNSSPSPVTVRRGLAIDLNEPPPLWL

SEQ ID NO: 25625 - protein, 1197 aa, Escherichia coli
MKFLPYIFLLCCGLWSTISFADEDYIEYRGISSNNRVTLDPLRLSNKELRWLASKKNLVIAVHKSQTATLLHTDSQQRVRGINADYLNLLKRALNIKLTLREYADHQKAMDALAEGEVDIVLSHLVTSPPLNNDIAATKPLIITFPALVTTLHDSMRPLTSPKPVNIARVANYPPDEVIHQSFPKATIISFTNLYQALASVSAGHNDYFIGSNIITSSMISRYFTHSLNVVKYYNSPRQYNFFLTRKESVILNEVLNRFVDALTNEVRYEVSQNWLDTGNLAFLNKPLELTEHEKQWIKQHPNLKVLENPYSPPYSMTDENGSVRGVMGDILNIITLQTGLNFSPITVSHNIHAGTQLSPGGWDIIPGAIYSEDRENNVLFAEAFITTPYVFVMQKAPDSEQTLKKGMKVAIPYYYELHSQLKEMYPEVEWIQVDNASAAFHKVKEGELDALVATQLNSRYMIDHYYPNELYHFLIPGVPNASLSFAFPRGEPELKDIINKALNAIPPSEVLRLTEKWIKMPNVTIDTWDLYSEQFYIVTTLSVLLVGSSLLWGFYLLRSVRRRKVIQGDLENQISSRKALSDSLPNPTYVVNWQGNVISHNSAFEHYFTADYYKNAMLPLENSDSPFKDVFSNAHEVTAETKENRTIYTQVFEIDNGIEKRCINHWHTLCNLPASDNAVYICGWQDITETRDLINALEVEKNKAIKATVAKSQFLATMSHEIRTPISSIMGFLELLSGSGLSKEQRVEAISLAYATGQSLLGLIGEILDVDKIESGNYQLQPQWVDIPTLVQNTCHSFGAIAASKSIALSCSSTFPEHYLVKIDPQAFKQVLSNLLSNALKFTTEGAVKITTSLGHIDDNHAVIKMTIMDSGSGLSQEEQQQLFKRYSQTSAGRQQTGSGLGLMICKELIKNMQGDLSLESHPGIGTTFTITIPVEISQQVATVEAKAEQPITLPEKLSILIADDHPTNRLLLKRQLNLLGYDVDEATDGVQALHKVSMQHYDLLITDVNMPNMDGFELTRKLREQNSSLPIWGLTANAQANEREKGLSCGMNLCLFKPLTLDVLKTHLSQLHQVAHIAPQYRHLDIEALKNNTANDLQLMQEILMTFQHETHKDLPAAFQALEAGDNRTFHQCIHRIHGAANILNLQKLINISHQLEITPVSDDSKPEILQLLNSVKEHIAELDQEIAVFCQKND

SEQ ID NO: 25626 - protein, 1197 aa, Escherichia coli
MKFLPYIFLLCCGLWSTISFADEDYIEYRGISSNNRVTLDPLRLSNKELRWLASKKNLVIAVHKSQTATLLHTDSQQRVRGINADYLNLLKRALNIKLTLREYADHQKAMDALAEGEVDIVLSHLVTSPPLNNDIAATKPLIITFPALVTTLHDSMRPLTSPKPVNIARVANYPPDEVIHQSFPKATIISFTNLYQALASVSAGHNDYFIGSNIITSSMISRYFTHSLNVVKYYNSPRQYNFFLTRKESVILNEVLNRFVDALTNEVRYEVSQNWLDTGNLAFLNKPLELTEHEKQWIKQHPNLKVLENPYSPPYSMTDENGSVRGVMGDILNIITLQTGLNFSPITVSHNIHAGTQLSPGGWDIIPGAIYSEDRENNVLFAEAFITTPYVFVMQKAPDSEQTLKKGMKVAIPYYYELHSQLKEMYPEVEWIQVDNASAAFHKVKEGELDALVATQLNSRYMIDHYYPNELYHFLIPGVPNASLSFAFPRGEPELKDIINKALNAIPPSEVLRLTEKWIKMPNVTIDTWDLYSEQFYIVTTLSVLLVGSSLLWGFYLLRSVRRRKVIQGDLENQISFRKALSDSLPNPTYVVNWQGNVISHNSAFEHYFTADYYKNAMLPLENSDSPFKDVFSNAHEVTAETKENRTIYTQVFEIDNGIEKRCINHWHTLCNLPASDNAVYICGWQDITETRDLINALEVGKNKAIKATVAKSQFLATMSHEIRTPISSIMGFLELLSGSGLSKEQRVEAISLAYATGQSLLGLIGEILDVDKIESGNYQLQPQWVDIPTLVQNTCHSFGAIAASKSIALSCSSTFPEHYLVKIDPQAFKQVLSNLLSNALKFTTEGAVKITTSLGHIDDNHAVIKMTIMDSGSGLSQEEQQQLFKRYSQTSAGRQQTGSGLGLMICKELIKNMQGDLSLESHPGIGTTFTITIPVEISQQVATVEAKAEQPITLPEKLSILIADDHPTNRLLLKRQLNLLGYDVDEATDGVQALHKVSMQHYDLLITDVNMPNMDGFELTRKLREQNSSLPIWGLTANAQANEREKGLSCGMNLCLFKPLTLDVLKTHLSQLHQVAHIAPQYRHLDIEALKNNTANDLQLMQEILMTFQHETHKDLPAAFQALEAGDNRTFHQCIHRIHGAANILNLQKLINISHQLEITPVSDDSKPEILQLLNSVKEHIAELDQEIAVFCQKND

SEQ ID NO: 25627 - protein, 429 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFNFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGA

SEQ ID NO: 25628 - protein, 429 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGGLWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGA

SEQ ID NO: 25629 - protein, 429 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHNTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGA

SEQ ID NO: 25630 - protein, 418 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFGFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRS

SEQ ID NO: 25631 - protein, 425 aa, Trypanosoma brucei
GAMDIVVNDDLSCRFLEGFNTRDALCKKISMNTCDEGDPFFVADLGDIVRKHETWKKCLPRVTPFYAVKCNDDWRVLGTLAALGTGFDCASNTEIQRVRGIGVPPEKIIYANPCKQISHIRYARDSGVDVMTFDCVDELEKVAKTHPKAKMVLRISTDDSLARCRLSVKFGAKVEDCRFILEQAKKLNIDVTGVSFHVGSGSTDASTFAQAISDSRFVFDMGTELGFNMHILDIGGGFPGTRDAPLKFEEIAGVINNALEKHFPPDLKLTIVAEPGRYYVASAFTLAVNVIAKKVTPGVQTDVGAHAESNAQSFMYYVNDGVYGSFNCILYDHAVVRPLPQREPIPNEKLYPSSVWGPTCDGLDQIVERYYLPEMQVGEWLLFEDMGAYTVVGTSSFNGFQSPTIYYVVSGLPDHVVRELKSQKS

SEQ ID NO: 25632 - protein, 425 aa, Trypanosoma brucei
GAMDIVVNDDLSCRFLEGFNTRDALCKKISMNTCDEGDPFFVADLGDIVRKHETWKKCLPRVTPFYAVACNDDWRVLGTLAALGTGFDCASNTEIQRVRGIGVPPEKIIYANPCKQISHIRYARDSGVDVMTFDCVDELEKVAKTHPKAKMVLRISTDDSLARCRLSVKFGAKVEDCRFILEQAKKLNIDVTGVSFHVGSGSTDASTFAQAISDSRFVFDMGTELGFNMHILDIGGGFPGTRDAPLKFEEIAGVINNALEKHFPPDLKLTIVAEPGRYYVASAFTLAVNVIAKKVTPGVQTDVGAHAESNAQSFMYYVNDGVYGSFNCILYDHAVVRPLPQREPIPNEKLYPSSVWGPTCDGLDQIVERYYLPEMQVGEWLLFEDMGAYTVVGTSSFNGFQSPTIYYVVSGLPDHVVRELKSQKS

SEQ ID NO: 25633 - protein, 861 aa, Saccharomyces cerevisiae
MFNRKRRGDFDEDENYRDFRPRMPKRQRIPPVVQLCKEMMPDIRTIGESVKAFEDDIKFLSEAIMNEYGHEDYFNNALLSTLNAVVVEQPQKQAAIALLTMVVNSKNNVAGKSIINYFFEELQKWCKQTYNDEFKSTSNETGPWNKIKLILRFLSILSPMFLVDELINIYKSLFELSIELNNLDPGNRVPLSEAIYTNTLLNIPYLFFFNRNNDGLRTKVEELLAYVEQNYLVKTTDINLLREYNGEPPYEMVELVRVVLPNVKKALINNLEQLNELFPDWNHLLTPQTGDEGFNDALTLPSVDDLKSFVRLNKNFGSVDSMWKTPRYAFHVYLPNSAGNFETVVPISTYAGQLFNDIIIDLVESLEFNRKEVARQVITLDLFFKAGIFTEPGESIAQLIATYEENPLAPTFKIEDLAIETILGLIFKLPSVSQPFAYFYTLLVDICQNSPKAIAPVFGRAFRFFYSHLDSLDFELKLRYLDWFSIQMSNFNFSWKWNEWEDDSIKFGKYFYNPKVNFAKNLIQKELRLTSNFSEVEDSLPQEFTKYLDTSYIPRDQLINYYQSLFTGYTVEEDSVRKNDLYFRQEGVPMENTVRKILDYTHKANNSREVTELESILGELKNEYGSIISDFNRFVIILLVQAVTDSGSRSLSHANKYINDLKEDLKTIFAKIELDIETKEYIIIEAVLTFWNANPQTGFLVADAFKYAGLLTSRTIFTFIFNETGLKNNGLIEATAIEAVFRNLSQQISEENESGNNFEFVFERLCTIANSTIDLLDVNADEDIEIPKVNGEMDIDDIEDDKLDLKWKYFTVIGFIKSILRRYSHEYRELADKFIANIDNAIPHESTRRTISNWIQETKEV

SEQ ID NO: 25634 - protein, 254 aa, Zymomonas mobilis
MSVSFDYSGKVALVTGAGTGIGRETALAFAKAKAYVAIIGRSENNIQETLRLVTEMGGQAIAIQADVSQEDSIKAAIEKTVETFGKLDFAFNNAGIEHKAIPAADIPSEEWDRIISTNLNGVFFSMKHEIPAMLKSGSGSIVNTASGAGVKGFPGNGAYCASKFGLIGLSKAAALDYAKQHLRINVVAPGIIETPMMQRFTGGTEEGRETAIAQEPVGRAGHPKEIAGTVLWLCSDLAAFTTGSVFVVDGGQTA

SEQ ID NO: 25635 - protein, 220 aa, Picea abies
MGRGKIEIKMIENESNRKVTFSKRRGGLFKKARELSVLCEAEVALIVFSSTGNHQEFASSSMKNILERYKASTGIGLLDYQDQMLSDMARIKRENEILHADLRYMMGEDLDSSDIKDMMSLEDHLDKVSGLVRKRKDKLMDNRLELQKKKTGLEWQIHNQLNENIACYHRARMEEQDKHDLYSNYGFYQLERPSTPLHALPPDPELRLQPNQPNLKDSGY

SEQ ID NO: 25636 - protein, 220 aa, Picea abies
MGRGKIEIKMIENESNRKVTFSKRRGGLFKKARELSVLCEAEVALIVFSSTGNHQEFASSSMKNILERYKASTGIGLLDYQDQMLSDMAQIKRENEILHAELRYMMGEDLDSSDIKDMMSLEDHLDKVSGLVRKRKDKLMDNRLELQKKKTGLEWQIHNQLNENIACYHRARMEEQDKHDLYSNYGFYQLERPSTPLHALPPDPELRLQPNQPNLKDSGY

SEQ ID NO: 25637 - protein, 236 aa, Picea abies
MGRGKIEIKKIENLTNRQVTFSKRKAGLQKKAKELSILCSAEVALIIFSSSGKHYEYSSPCSSVEQIVEKYMNVSGSKLGEDQINTLIDGCVVKGDIEIVGLRRVIRHLTGGDLESLSVNELQKLEDQLEIVTSRVRKKRFQRMQEQLEAMTQELEESKRRLRYNEGFTQKKNDLYMFSDCRGSLGETVDDYPFCQDKNPIYVTPSAPVFCVQPGQPHLHETDYRYLDLKLGYNRN

SEQ ID NO: 25638 - protein, 238 aa, Picea abies
MGRGKIEIKKIENLTNRQVTFSKRKAGLQKKAKELSILCSAEVALIIFSSSGKHYEYSSPCSSVEQIVEKYMNVSGSKLGEDQINTLIDGCVVKGDIEIVGLRRVIRHLTGGDLESLSVNELQKLEDQLEIVTSRVRKKRFQRMQEQLEAMTQELEESKRRLRYNEGFTQKKNDLYMFSDCRRSLGETVDDYPFCQLEDKNPIYVTPSAPVFCVQPGQPHLHETDYRYLDLKLGYNRN

SEQ ID NO: 25639 - protein, 215 aa, Picea abies
MGRGKIEIKMIENPTNRQVTFSKRRGGLTKKAQELSVLCNAEVALIVFSNTGKLHQWSSSSMKKVLERYQKSEQGLGLMDYQHQQLLFEMRRITKENESLQARLRHMRGEDINSLKLPELFNLEEQLELAGTQVRRRKDHVLDNEKTKRQNKERRLQQENMILQEMVDQHHGHMEEDNGEINFVLCQPLKRLSTAFPAPLLRLQPNQPNLQDIGY

SEQ ID NO: 25640 - protein, 219 aa, Picea abies
MGRGKIEIKMIENPTNRQVTFSKRRGGLTKKAQELSVLCNAEVALIVFSNTGKLHQWSSSSMKKVLERYQKSEQGLGLMDYQHQQLLFEMRRITKENESLQARLRILYRHMRGEDINSLKLPELFNLEKQPELAGTQVRRRKDHVLDNEKIKGKNKERRLQQENMILQEMVDQHHGHMEEDNGEINFVLCQPLKRLSAAFPAPLLRLQPNQPNLQDIGY

SEQ ID NO: 25641 - protein, 375 aa, Gallus gallus
STVGKVIKCKAAVLWEANKPFSLEEVEVAPPKAHEVRIKIVATGICRSDDHVVTGALAMPFPIILGHEAAGVIESVGEKVTSLKPGDAVIPLFVPQCGECRSCLSTKGNLCIKNDLSSSPTGLMADGTTRFTCKGKAIHHFVGTSTFTEYTVVHETAAAKIDSAAPLEKVCLIGCGFSTGYGAVLQTAKVEAGSTCAVFGLGGVGLSVVMGCKAAGASRIIAVDINKDKFAKAKELGATECINPKDFKKPIHEVLTEMTGQGVDYSFEVIGRIETMTAALASCHNNYGVSVIVGVPPAAQKISFDPMLIFSGRTWKGSVFGGWKSKDAVPKLVADYMKKKFVLDPLITHTLPFTKINEGFDLLRTGKSIRSVLVL

SEQ ID NO: 25642 - protein, 402 aa, Cyanidioschyzon merolae
MFATTGRLYQTLRVHPSHRALQSVRKRVRSRGQCPLRSARLQHVRGHGRSSNDGVSEARDSAIEHITDTRSETSRSAAVGARVVWPLGSPPQIGGGFGPVISVDDMVRTLTYSSDPVWELVRREAEIGAANEPQLASSLYATVLNHRCLEDTLAFHLANELASPFFQATQYVKLFRDALYQDKSYREAIRADLLAVVRRDPAMKHCVAVLMYSKGYAALQAYRLAHLLWRQDRKVLALFLQSEISKCFAVDIHPAARIGSGVMIDHATGIVIGETAVVGNDVSMLHNVTLGGTGKEAGDRHPKVGRGVLLGAGATVLGNIRIGDGAQITASSVVLKDVPPYTIVSGVPAREVGKLSYPKGVYPAFEMDQRAATAARVHSTNRARQHAEDSNSSTDWYLGDAI

SEQ ID NO: 25643 - protein, 161 aa, Trema virgata
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDQLVAAIKFEVKPSST

SEQ ID NO: 25644 - protein, 161 aa, Trema virgata
MSSSEVDKVFTEELEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDQLVAAIKFEVKPSST

SEQ ID NO: 25645 - protein, 161 aa, Trema virgata
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSAEMKNAWGEAYDLLVAAIKFEVKPSST

SEQ ID NO: 25646 - protein, 410 aa, Gallus gallus
MVLSQRQRDELNRAIADYLRSNGYEEAYSVFKKEAELDVNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHTGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSTISEATGSETKKSGKPGPFLLSGSRDKTIKMWDISTGMCLMTLVGHDNWVRGVLFHSGGKFILSCADDKTLRVWDFKNKRCMKTLNAHEHFVTSLDFHKTAPYVVTGSVDQTVKVWECR

SEQ ID NO: 25647 - protein, 289 aa, Allium cepa
MPCSTLPIPTFPPPESESDESWVWNQIKAEAHRDAESEPALASYLYSTIISHPSLARSLSFHLANKLCSSTLLSTSLYDLFLNTLSTFPTVLSASVADLIAARHRDPACVGFSHCLLNFKGFLAVQTQRIAHVLWSQSRRPLALALHSRVADVLSVDIHPAARIGKGILLDHATGVVIGETAVIGNNVSILHHVTLGGTGKAGGDRHPKIGDGVLIGAGATILGNIRIGAGAKVGAGSVVLIDVPPRTTAVGNPARLIGGKEKPSVHEDVPGESMDHTSFISEWSDYII

SEQ ID NO: 25648 - protein, 312 aa, Allium cepa
MALLVEKTSSGREYKVKDMSQADFGRLELELAEVDMPGLMACRTEFGPSQPFKGARITGSLLMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKNGTLPDPSSTDNAEFQIVLTIIRDGLKVDPTKYRKMKERLVGVSEETTTGVKRLYQMQASGALLFPAINVNDSVTKSKFDNLYGCRHSLPDGLMRATDVMIAGKVAFVAGYGDVGKGCAAALKQAGARVIVSEIDPICALQPQWKGLQVLPLE

SEQ ID NO: 25649 - protein, 246 aa, Oryza sativa
MGRGKVQLKRIENKINRQVTFSKRRSKLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHERIGLPPWMLSHING

SEQ ID NO: 25650 - protein, 267 aa, Oryza sativa
MGRGKVQLKRIENKINRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDHESLNLKELQQLEQQLESSLKHIISRKSHLMLESISELQKKERSLQEENKALQKELVERQKNVRGQQQVGQWDQTQVQAQAQAQPQAQTSSSSSSMLRDQQALLPPQNICYPPVMMGERNDAAAAAAVAAQGQVQLRIGGLPPWMLSHLNA

SEQ ID NO: 25651 - protein, 245 aa, Petunia x hybrida
MGRGRVQLKRIENKINRQVTFSKRRSGLLRKAHEISVLCDAEVGLIVFSTKGKLFEYSTDSCMERILERYERYSYAERQLSGATDNDTPGSWTLEHAKLKARLEVLQRNQKHYAGEDLDSLSMKELQNLEQQLDSALKQIRSRKNQLMHESISELQKKDKALQEQNNKLSKQVKEREKELAQQSQWEPQSHDLNSSSFVLSQPLNSLHLGEAYPSAGDNGEVEGSSRQQPPNTVMPPWMLRHLNG

SEQ ID NO: 25652 - protein, 395 aa, Eptatretus burgeri
STGIYEALELRDGDKSRYLGKGVLKAVNHINATIAPKLIAKNFNVKDQTAIDKFMLDLDGTENKSQFGANAILGVSLAVCKAAAAEKGVPLYRHIADLAGHKDVILPVPAFNVINGGSHAGNKLAMQEFMILPVGAANFHDAMRIGAEVYHNLKSVIKDKYGKDATNVGDEGGFAPNILDNQEALELLKHAINKAGYTDKIVIGMDVAASEFYRDGKYDLDFKSPDDPSRHISPDKLADLYHGFIKDYPVVSIEDPFDQDHWEAWTKFTASTDIQVVGDDLTVTNPKRIQKGVDIKACNCLLLKVNQIGSVTESIQACKLAQNNGWGVMVSHRSGETEDSFIADLVVGLCTGQIKTGAPCRSERLAKYNQMMRIEEELGSNAKFAGKNFRHPMAH

SEQ ID NO: 25653 - protein, 394 aa, Lethenteron reissneri
STGIYEALELRDDDKGRYLGKGVLQAVSHINDTIAPALLSQSFSVVEQEAIDQFMLDLDGTENKSKFGANAVLGVSLAVCKAGAGEKGVPLYRHIADLAGNSEVILPVPAFNVINGGSHAGNKLAMQEFMILPVGAESLSEALRMGAEVYHSLKAVIKKKYGQDATNVGDEGGFAPNILENMEALDLLTQAIGKAGYTDKIVIGMDVAASEFYRDGKYDLDFKSPADPDRYISADELADLYRTFISDYPVVSIEDPFDQDDWEAWSNFTANAGIQIVGDDLTVTNPARIQTAVDVKACNCLLLKVNQIGSVTESIKACKLAQSNGWGVMVSHRSGETEDTFIADLVVGLCTGQIKTGAPCRSERLAKYNQLMRIEEELGKKAQFAGRNFRHPMA

SEQ ID NO: 25654 - protein, 395 aa, Lethenteron reissneri
STGIYEALELRDGDKSRYLGKGVLKAVNHINKEIAPALIAKNFSVVDQEKIDNFMLELDGTENKSKFGANAILGVSLAVCKAAAAEKGVPLYRHIADLAGHKEVILPVPAFNVINGGSHAGNKLAMQEFMILPVGASSFHEALRIGAEVYHNLKGVIKEKYGKDATNVGDEGGFAPNILENKEALELLKTAINKAGYSDKIVIGMDVAASEFYRKGMYDLDFKSPDDPKRYITPDKLAELYQGFTKDYPVVSIEDPFDQDDWEAWTKITANTKIQIVGDDLTVTNPKRIQKAVDVKACNCLLLKVNQIGSVTESIKACKLAQNNGWGVMVSHRSGETEDTFIADLVVGLCTGQIKTGAPCRSERLSKYNQIMRIEEELGDKAKFAGHSFRNPQIK

SEQ ID NO: 25655 - protein, 484 aa, Comamonas testosteroni
MKDIQNFINGAYVSTGRSFDKHSPLTGKVIAKVHEAGRNEVDAAVTAARTALNGPWGRMSVAERVEKLYAVADGINRRFEEFLAAECADTGKPRSVASHIDIPRGAANFKIFADVVKNVPTEFFEMATPDGRGAINYGHRGPVGVVGVICPWNLPLLLMTWKVGPALACGNTVVVKPSEESPQTAALLGEVMNEAGIPPGVYNVVHGFGPDSAGEFVTSHPGVDAITFTGETRTGEAIMKAAAKGARPVSLEMGGKNAAIVFADCDFDAAIDGTLRSAFVNSGQVCLGTERVYVERPIYERFVAALKQQIEGWKIGVPEDDDTKLGPLISKEHQAKVLSYYQLAVQEGATVVTGGGMPDLGAQYADGAWVQPTIWTGLPETARVIKEEIFGPCCHIAPFDTEEEVLTKANDNVYGLASAIWTQDLARAHRVAQRMHVGISWVNSWFLRDLRTPFGGAKQSGIGREGGVHSLEFYTELKNVCIKL

SEQ ID NO: 25656 - protein, 566 aa, Oryctolagus cuniculus
MEKYENLGLVGEGSYGMVMKCRNKDSGRIVAIKKFLESDDDKMVKKIAMREIKLLKQLRHENLVNLLEVCKKKKRWYLVFEFVDHTILDDLELFPNGLDDQVVQKYLFQIINGIGFCHSHNIIHRDIKPENILVSQSGVVKLCDFGFARTLAAPGEVYTDYVATRWYRAPELLVGDVKYGKAVDVWAIGCLVTEMLMGEPLFPGDSDIDQLYLIMRCLGNLIPRHQELFYKNPVFAGVRLPEIKESEPLERRYPKLSEVVIDLAKKCLHVDPDKRPFCAELLHHDFFQMDGFAERFSQELQMKVQKDARNISLSKKSQNRKKEKEKDDSLGEERKTLVVQDTNVDSKFKDSKVFKIKGSKIDGEKVDKGNRAAVSMTVGPSHIKAVPSTSLRDCSNVSVDHTRNPGMAIPPLTHNLSAVAPGINSGMGTIPGVQSYRVDEKTKKYCIPFVKPNKHSPSGIYNMNVTTSVSSEKNLLQANKKRGEYSKTDVRLPELNYNHLPELRALEGIARNSRLIRKENKILSESRIPSLAAIDLHTPNIAVHQVSGSPLSDGSEADSPWMEHQH

SEQ ID NO: 25657 - protein, 353 aa, Panulirus argus
MACCLSEEAKEQKRINQEIERQLRKDKRDARRELKLLLLGTGESGKSTFIKQMRIIHGAGYSDEDKRGFIKLVFQNIFMAMQSMIRAMDLLQISYGDSANIEHADLVRGVDYESVTTFEEPYVTAMKSLWQDTGIQHCYDRRREYQLTDSAKYYLTDLDRIAATDYVSTLQDILRVRAPTTGIIEYPFDLEEIRFRMVDVGGQRSERRKWIHCFENVTSIIFLVALSEYDQILFESDNENRMEESKALFKTIITYPWFQHSSVILFLNKKDLLEEKIMYSHLVDYFPEYDGPRKDAIAAREFILRMFVELNPDPEKIIYSHFTCATDTENIRFVFAAVKDTILQLNLKEYNLV

SEQ ID NO: 25658 - protein, 619 aa, Neurospora crassa
MKFLGIAALVAGLLAPSLVLGAPAPGTEGVNLLTPVDKRQDSQAERYGGGGGGGCNSPTNRQCWSPGFNINTDYELGTPNTGKTRRYKLTLTETDNWIGPDGVIKDKVMMVNDKIIGPTIQADWGDYIEITVINKLKSNGTSIHWHGMHQRNSNIQDGVNGVTECPIPPRGGSKVYRWRATQYGTSWYHSHFSAQYGNGIVGPIVINGPASANYDVDLGPFPLTDYYYDTADRLVLLTQHAGPPPSNNVLFNGFAKHPTTGAGQYATVSLTKGKKHRLRLINTSVENHFQLLLVNHSMTIISADLVPVQPYKVDSLFLGVGQRYDVIIDANQAVGNYWFNVTFGGSKLCGDSDNHYPAAIFRYQGAPKALPTNQGVAPVDHQCLDLNDLKPVLQRSLNTNSIALNTGNTIPITLDGFVWRVNGTAININWNKPVLEYVLTGNTNYSQSDNIVQVEGVNQWKYWLIENDPDGAFSLPHPIHLHGHDFLILGRSPDVTAISQTRYVFDPAVDMARLNGNNPTRRDTAMLPAKGWLLIAFRTDNPGSWLMHCHIAWHVSGGLSNQFLERAQDLRNSISPADKKAFNDNCDAWRAYFPDNAPFPKDDSGLRSGVKAREVKMKW

SEQ ID NO: 25659 - protein, 528 aa, Homo sapiens
REPAALTARRRTMEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 25660 - protein, 103 aa, Pyrenomonas salina
MSGRGKGGKGLGKGGAKRHRKVLRDNIQGITKPAIRRLARRGGVKRISGLIYEETRSVLKVFLENVIRDAVTYTEHARRKTVTAMDVVYALKRQGRTLYGFGG

SEQ ID NO: 25661 - protein, 101 aa, Schizosaccharomyces pombe
MSSVESFVDSAVADNDVVVFAKSYCPYCHATEKVIADKKIKAQVYQIDLMNDGDEIQSYLLKKTGQRTVPNIFIHQKHVGGNSDFQALFKKGELDSLFNTA

SEQ ID NO: 25662 - protein, 311 aa, Oryza sativa (indica cultivar-group); identical to SEQ ID NO: 3950

SEQ ID NO: 25663 - protein, 372 aa, Pseudomonas sp.
MIKSRAAVAFAPNQPLQIVEVDVAPPKAGEVLVRVVATGVCHTDAYTLSGADSEGVFPCILGHEGGGIVEAVGEGVTSLAVGDHVIPLYTAECRECKFFKSGKTNLCQKVRATQGKGLMPDGTSRFSYNGQPIYHYMGCSTFSEYTVLPEISLAKIPKNAPLEKVCLLGCGVTTGIGAVLNTAKVEEGATVAIFGLGGIGLAAIIGAKMAKASRIIAIDINPSKFDVARELGATDFVNPNDHAKPIQDVIVEMTDGGVDYSFECIGNVRLMRAALECCHKGWGESVIIGVAPAGAEINTRPFHLVTGRVWRGSAFGGVKGRTELPSYVEKAQQGEIPLDTFITHTMGLDDINTAFDLMDEGKSIRSVVQLSR

SEQ ID NO: 25664 - protein, 246 aa, Petunia x hybrida
MGRGRVQMKRIENKINRQVTFSKRRSGLLKKAHEISVLCDAEVGLIVFSTKGKLFEYATDSCMERILERYERYSYAERQLVSTDHSSPGSWNLEHAKLKARIEVVQRNQRHYMGEDLDSLSMKDLQNLEQQLDSSLKHIRSRKNQLMHESISELQKKDKSLQEQNNLLSKKVKEREKELAQQTQWEQQNNHHEINSSSSFVLPQPLDSPHLGEAYQSTVDNGEVEGASQQQPANTMPPWMLRHLNG

SEQ ID NO: 25665 - protein, 861 aa, Nicotiana tabacum
MMMVGKLFSLLHFFTLFCLFTVTFASTKEATALLKWKATLQNQSNSLLVSWTPSSKACKSWYGVVCFNGRVSKLDIPYAGVIGTLNNFPFSSLPFLEYIDLSMNQLFGSIPPEIGKLTNLVYLDLSFNQISGTIPPQIGSLAKLQTLHILDNHLNGSIPGEIGHLRSLTELDLSINTLNGSIPPSLGNLHNLSLLCLYKNNISGFIPEEIGYLSSLIQLDLNTNFLNGSIPASLENLHNLSLLYLYENQLSGSIPDEIGQLRTLTDIRLNTNFLTGSIPASLGNLTSLSILQLEHNQLSGSIPEEIGYLRTLAVLSLYTNFLNGSIPISLGNLTSLSSLSLYENHLSGPIPSSLGNLDNLVYLYLYANQLSGPIPSELGNLKNLNYMKLHDNQLNGSIPASFGNLRNMQYLFLESNNLTGEIPLSICNLMSLKVLSLGRNSLKGDILQCLINISRLQVLKIPDNNLSEEIPSSICNLTSLRILDLSRNNLKGSIPQCFGDMGGHLEVLDIHKNGISGTLPTTFRIGSVLRSFTLHENELEGKIPRSLANCKELQVLDLGDNLLNDTFPMWLGTLPKLQVLRLKSNKLYGSIRTSKDENMFLELRIINLSYNAFTGNIPTSLFQQLKAMRKIDQTVKEPTYLGKFGADIREYNYSVTVTTKGLELKLVRILTVYIIIDLSSNRFEGHVPSIMGELIALRVLNLSRNGLQGHIPPSLGNLFVIESLDLSFNQLSGEIPQQIASQLTSLAVLNLSYNHLQGCIPQGPQFHTFENNSYEGNDGLRGFPISKGCGNDRVSETNNTVSTLDDQESTSEFLNDFWKAALMGYGSGLCIGLSILYFMISTGKLKWLSRITEWLQNRFII

SEQ ID NO: 25666 - protein, 234 aa, Lactuca sativa
MDHAADAFRTDLMTITRFVLNEQSKHPESRGDFSILLSHIVLGCKFVCSAVNKAGLAKLIGLAGETNVQGEEQKKLDVLSNEVFVKALVSSGRTCILVSEEDEDAIIVEPSKRGRYCVVFDPLDGSSNIDCGVSIGTIFGIYMIKDGDEAILEDVLQPGKNMVAAGYCMYGSSCTLVLSTGSGVNGFTLDPSLGEFILTHADIKIPKKGKIYSVNEGNAKNWDGPTAKFVEKCK

SEQ ID NO: 25667 - protein, 483 aa, Ralstonia eutropha
MELQHTALLRTHCLIDGEWTGAQSGAELAVCNPATGERIGSVPLAGAAEAEQAVRAAERALPAWRAQTGKAVPPVLRRWADLMLAHQEDLARLMTAEQGKPLPDARGEVAYAASFLEWFGEEAKRVDGEVLASPRSSQKMLVLREPVGVCAAITPWNFPAAMITRKVGPALAAGCTIIVKPAEQTPLTALALAVLGEQAGVPRGVLQVVTGDAVQIGGVLCASPVVRKLSFTGSTAIGKLLMAQCAGTVKKLSLELGGNAPLIIFDDADMDSAVEGIIASKFRNTRQTCVCANRIYVHDRVYDEVARRLVSAVEQLLPGHGVDSGVTQGPLIDADAVAKVEAHIADALAQGATVLTGGQRHALGGTFFAPTVLANATASMRVAREETFGPLAPLFRFTSEAEVVAMANDTESGLAAYFFSRDMAKIWRVAQGLEYGMVGINTGLISNEVAPFGGVKQSGLGREGSRHGIDEYLETKYLCMEVE

SEQ ID NO: 25668 - protein, 214 aa, Elaeis guineensis
MVRGKTEMKLIENATSRQVTFSKRRNGLLKKAFELSVLCDAEVAVIVFSPRGKLYEFSSTSMEKTIDRYRRHAKSGINNNEVTQQWKFEAASMSRKIESLEVSKRKLLGENLESCSAEELHEIEGKIEQSLCHVRGKKNQLLEEQIATLKEQEQTLMEENALLREKCKLQSQLRPAAAPEETVPCSQDGENMEVETELYIGWPGRGRTNCRSQG

SEQ ID NO: 25669 - protein, 559 aa, Prunus dulcis
  unsure (1)..(559): unsure at all Xaa locations
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 25670 - protein, 224 aa, Helianthus annuus
NDFFDYVLEELKQNDTMLTEATALDLMFALLFANFETTSQAITVAIKFLTHNPRALKELTEEHQKILRKRENPKLDLHGKNIVDEIYLQVINETLRLASIVPVLFRKAKKDIKFKGYTIPSGWAVMVCPPAVHLDPVNYKDPLDFNPWRWEDMDLKSASKTFMAFGGGQRFCVGADFAKLQIAIFLHCLVTKYQWQPIKGGDIVRTPGLQFPNGFHVRIFEKET

SEQ ID NO: 25671 - protein, 331 aa, Xenorhabdus nematophila
MSQSTLKVNELYDDADLDENSMEADDFDEALLKNGDDVTNLDEDLDLLQGVNQRMLDATQLYLGEIGFSPLLTAEEEVLFARRALRGDIAARQRMIESNLRLVVKISRRYSNRGLALLDLIEEGNLGLIRAVEKFDPERGFRFSTYATWWIRQTIERAIMNQTRTIRLPIHIVKELNVYLRTARELAHKLDHEPTVEEIAERLDKPVEDISRMMRLNERITSVDTPISGDSDKALLDILSDENDSGPETTIQDDDMKQSIVKWLFELNAKQREVLARRFGLLGYEAETLEDVGREIGLTRERVRQIQVEGLRRLRDILHTQGLNLESLFRT

SEQ ID NO: 25672 - protein, 574 aa, Brassica juncea
SMSVIVWWLATMVMVAVHSASAGVVELNWEVEYKLGWPDCKEGIVIAINGEFPGPTINAVAGDTVIVHVTNKLSTEGVVIHWHGIRQNGTPWADGAAGVTQCPINPGETLTYNFIVDKAGTHFYHGHYGMQRSAGLYGMMIVRSPKETLQYDGEFNLLLSDWWHQSSHAQELYLSSRPMRWIGEPQSLLINGRGQFNCSLAAYFNKGGLKECKFKENDECAPSILRVEPNKVYRLRIASTTALASLNFAVEGHQLEVVEADGNYIAPFTVDDIDLYSGETYSVLLRTHNPTPSRNYWISVGVRGRKPNTTQALTVLHYAGAPEFEHLPHPPPVTPRWDDYDRSKSFTNKIFAAKGYPPPPEKSDEQLFLLNTQNLMDKYTKWAINNVSLSVPATPYIGTIRYGLKTLNYQKPPGKEIMRDYDITKPPVNPNTTKGSGIYNLQSGRVVDVILQNANVLKGRGSEIHPWHLHGHDFWVLGYGEGKFRLGVDEKTYNLKNPPLRNTVALYPYGWTALRFLTDNPGVWFFHCHIEPHLHMGMGVVFAEGVDKIAKMNIPDQVLGCGSTREFLMNRGRH

SEQ ID NO: 25673 - protein, 574 aa, Brassica juncea
WWIVAVAILAHTASASVREYHWEVEYKFGFPDCKEGMVMAINGKFPGPTIHALAGDTIVVHLTNKLATEGLVIHWHGIRQLGSPWADGAAGVTQCAITPGETFTYRFTVEKPGTHFYHGHYGMQRSAGLYGSLIIDAAKGKREPLRYDGEFNLLLSDWWHESILSQELGLSAKPMRWIGEAQSILINGRGQFNCSLAAQFSNATAQFSNTSLPMCKFKKGDQCAPQRLHVQPNKTYRIRLASTTGLASLNFAVQGHKLMVVEADGNYITPFATSEIDIYSGESYSVLLTTDQDPSQNYWISVGVRGRKPKTPPALTVLHYVTAPSSQPHSSPPPETPRWNDFDRSKSFSRKILAAMGSPPPPRKFKKRLILLNTQNTIDGATKWALNNVSLVVPATPYLGSGKYRLRRGFDRKSPPTTFPVDYDIMNPPRNRNTTKGNGIYVFPFNVTVDVILQNANGLDANASEIHPWHLHGHDFWVLGYGEGKFRPGVDEKTYNLKNPPLKNTVALFPYGWTALRFVTDNPGVWFFHCHIEPHLHMGMGVVFAEGLNRIGKIPDEALGCGLTKQFLMNRNNP

SEQ ID NO: 25674 - protein, 573 aa, Brassica juncea
WIVAVAILAHTASASVREYHWEVEYKFGFPDCKEGMVMAINGKFPGPTIHALAGDTIVVHLTNKLTTEGLVIHWHGIRQLGSPWADGAAGVTQCAITPGETFTYRFTVEKPGTHFYHGHYGMQRSAGLYGSLIIDAAKGKREPLRYDGEFNLLLSDWWHESILSQELGLSAKPMRWIGEAQSILINGRGQFNCSLAAQFSNATAQFSNTSLPMCKFKKGDQCAPQRLHVQPNKTYRIRLASTTGLASLNFAVQGHKLMVVEADGNYITPFATSDIDIYSGESYSVLLTTDQDPSQNYWISVGVRGRKPKTPPALTVLHYVTAPSSQPPSSPPPETPRWNDFDRSKSFSRKILAAMGSPPPPRKFKKRLILLNTQNTIDGATKWALNIVSLVVPATPYLGSVKYRLRRGFDRKSPPTTFPVDYDIMNPPRNRNTTKGNGIYVFPFNVTVDVILQNANGLDANASEIHPWHLHGHDFWVLGYGEGKFRPGVDEKTYNLKNPPLKNTVALFPYGWTALRFVTDNPGVWFFHCHIEPHLHMGMGVVFAEGLNRIGKIPDEALGCGLTKQFLMNRNNP

SEQ ID NO: 25675 - protein, 595 aa, Dunaliella tertiolecta
MASVDCTLVSARGIKDVEIVGKQSPYAVLTVGPKTFKSGTANGGGSDPVWNQTFSFTNVTPDSSVKLEIFNSNVVLRDVAIGGCKAPMDKALSAGKDELTLPIITKKGKPHGEVKLILTLKPDATKQMVTSHKTRKAAGAWILPTYGNTDCWKDYEPGTLLGKGTFGTTYLATEKKTGQKCAVKVISKRKLTTPDEVDDVKKEVQIMHHLAGHPNVVGLKGVYEDKSNVCLAMEVATGGELFDSIVKRGHYSERDAAELIRTIVSVVAHCHNMGVIHRDLKPENFLLSDKSPRAQLKATDFGLSSFFQEGQVFTDIVGSAYYVAPEVLRRSYGKEADIWSCGIILYILLCGFPPFHGDSEKKIFEAIISKSVDFNTQPWPRISAPAKDCVKRMLQRDPKKRATANEIMQHDWMRENGVASDEPLEMEVVSRIKNFSGMNKLKKEALKVIAVNLPIDEISGMREMFMDIDKDKSGNITIDEFAAALHKKGQIVTEKEIEKIMKEADVDGDGTIDYEEFLAATINLGKLQREENLKTAFEHFDLDGNGEISHNELVQCLSKLGINDAHVKDIIKEVDADGNGQIDYNEFCIMMRNLD

SEQ ID NO: 25676 - protein, 253 aa, Fragaria x ananassa
MAFTSCLAITLLVSVLNLCIRGTYADYGAGWVGGHATFYGGGDASGTMGGACGYGNLYSQGYGTNTAALSTALFNDGLSCGSCYEMRCDNDPRWCLPGSIIVTATNFCPPNFAQANDNGGWCNPPLQHFDLAEPAFLQIAQYRAGIVPVSFRRVACVKKGGIRFTINGHSYFNLVLITNVAGAGDVHSVSIKGSKGGWQSMSRNWGQNWQSNNYLNGQALSFQVTTSDGRTVTSNNVAPGNWQFGQTFSGGQF

SEQ ID NO: 25677 - protein, 373 aa, Rana perezi
MCTAGKDITCKAAVAWEPHKPLSLETITVAPPKAHEVRIKILASGICGSDSSVLKEIIPSKFPVILGHEAVGVVESIGAGVTCVKPGDKVIPLFVPQCGSCRACKSSNSNFCEKNDMGAKTGLMADMTSRFTCRGKPIYNLVGTSTFTEYTVVADIAVAKIDPKAPLESCLIGCGFATGYGAAVNTAKVTPGSTCAVFGLGGVGFSAIVGCKAAGASRIIGVGTHKDKFPKAIELGATECLNPKDYDKPIYEVICEKTNGGVDYAVECAGRIETMMNALQSTYCGSGVTVVLGLASPNERLPLDPLLLLTGRSLKGSVFGGFKGEEVSRLVDDYMKKKINVNFLVSTKLTLDQINKAFELLSSGQGVRSIMIY

SEQ ID NO: 25678 - protein, 353 aa, Sporothrix schenckii
MGCGMSVEEKEGKARNEEIENQLKRDRMQQRNEIKMLLLGAGESGKSTILKQMKLIHEGGYSRDERESFKEIIYSNTVQSMRVILEAMESLELPLEDQRMEYHVQTIFMQPAQIEGEVLPPEVGNAIEALWKDAVVQECFKRSREYQLNDSARYYFDNIARIAAPDYMPDDQDVLRSRVKTTGITEKTFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDYEGGDDYAAACDYILNRFVNLNQHESKQIYTHFTCATDTTQIRFVMAAVNDIIIQENLRLCGLI

SEQ ID NO: 25679 - protein, 148 aa, Vicia faba
MEFTLRQEALVNSSWEAFNQNLPLFSVLFYTFILEKAPIAKNMFSVLKDANEIPLANPSINAHTEMVFEMVRDAAAQLQTTGQVVLGDTTLGVVHTQKRVDGLHFMVVKEALLKTIKEAVGDKWSEELSNAWEIAYDGLAVAIMKEMS

SEQ ID NO: 25680 - protein, 249 aa, Schistosoma mansoni
MTEREALVYRAKLAEQLERYDEMVDAMKEVVEMAEELTVEERNLLSVAYKNVIGSRRSSWRVFSAVEQTEGNRGNAEKQACAKKFREVLESELDRVSKDILELIDKYLIKSATKSDSKVFYLKMKGDYFRYMAEFSVDPQRKKAAEESNKAYQEASEIAATQLFPTHPIRLGLALNYSVYFYEIMNDPDEACRLAQAAFDDAIAKLDQLSEESYKDSTLIMQLLRDNLTLWTSDPERDDNVKKDTDEKA

SEQ ID NO: 25681 - protein, 166 aa, Pneumocystis carinii
EPPAPPSQPEPPAPQPQPEPPAPPPQPEPPAPPPQPEPPAPPPQPEPPAPPSQPEPPAPPPQPEPPAPPPQPEPPAPPPKPQPEQKPTSITSSTFTTSSSKTKISTIRKASSTKTSSTTKTSTRPSPTEGTFTGSSASYLSFFEKRHLLLQMILLLFFFLFLSYSF

SEQ ID NO: 25682 - protein, 173 aa, Canis familiaris
GNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLIIQQVFDNGSIYNPEVLDITEETLHSRFLEGVRNVASVCLQIGYPTVASVPHSIINGYKRVLALSVETD

SEQ ID NO: 25683 - protein, 245 aa, Capsicum annuum
MGRGRVELKRIENKINRQVTFAKRRNGLLKKAYELSVLCDAEVALIIFSNRGKLYEFCSTSSMVKTIEKYQRCSYATLEANQSATDTQNNYHEYLRLKARVELLQRSQRNFLGEDLGTLSTKDLEQLENQLESSLKQIRSRKTQFMLDQLADLQQREQMLAESNRLLRRKLEESTAGFPVRLSWEDGADQAMHQHNRLPHTEGFLQPLGLHSSPPHFGYNPVNTDEVNAAATAHNMNGFIHGWML

SEQ ID NO: 25684 - protein, 578 aa, Mycoplasma hyopneumoniae
MAKLNSYKFKGIGASSGIAIAKVFKLVEQKIEISDQKVEDISTEIQIFEEGVKKSVSQIEKIKKLATKLAKDELEILDAHILIATDPVLKEDTINLIKQGYSAAYSLKETAKNHTNFLLETGDEYLMARATDIKDASQRIIKNILNLNILDLSAIDKDVIIVADDLKPSDTAQLNSYVKGFATNIGSKTSHSAIMARSLEIPAILGVSDILEKVENDDILAINGDLGYGIINPNQEEIEEFERQKANFEAEKEKLQEFLNKKATSADGKKVVIAANIGSVEDSYAAKKVNADEIGLFRSEFLYMDRSNWPSEEEQFLSYKAVIESQNPKKVVVRTLDIGGDKTLKYFDFAKELNPFLGYRAIRLCLDKLEIFKTQLRALVRASEFGNLAIMFPMVASLDEFFQARAVFDEVYNQIKAKYPNVAPKSNIKIGIMIEIPISAILADKFAEHVDFFSIGTNDLIQYSFAADRMNEKVAYLYQTLNPGLLKLIKMTIDAAHAKGKWVGMCGEMAGDINAVPLLLGLGLDEFSVSASSVLKVKKLISELNYQKMQEIAKKTLEFSTEEQVIKYLESLNLIRHN

SEQ ID NO: 25685 - protein, 130 aa, Pimpinella brachycarpa
GTRESKVFYLKMKGDYHRYMAEFKVGDERKNAAEDTMNSYKAAQDIALADLAPTHPIRLGLALNFSVFYYEILNSSDKACSMAKQAFEEAIAELDTLGEESYKDSTLIMQLLRDNLTLWTSDSQDQLDEP

SEQ ID NO: 25686 - protein, 434 aa, Brassica insularis subsp. insularis
SYTLLFFVILFLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPEDTLLQEMKLGRNLIGSENEKILTSWKSPTDPSSGDYSFILETEGFLHEFYLLKNEFKVYRTGPWNGVRFNGIPKMQNWSYIDNSFIDNNEEVAYSFQVNNNHNIHTRLRMSSTGYLQVITWTKTVPQPNKFWSFPEDTCDLHKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTEELDDMRKYDAGGQDLYVKVAAASLVPS

SEQ ID NO: 25687 - protein, 269 aa, Pimpinella brachycarpa
MGRQPCCDKLGVKKGPWTADEDNKLINFILTNGQCCWRAVPKLAGLRRCGKSCRLRWTNYLRPDLKRGLLTDAEEQLVIDLHARLGNRWSKIAGRLPGRTDNEIKNHWNTHIKKKLIKMGIDPVTHEPLHKEETNSQKEILLQPFQSPAETENHVPPIPHTNDMASSENSCTPTDQNSSGDESNSLSAICDQIDDSLISYLFEDDTPGLVDAPWENFNKVDMVLPSWDESFPWLLDCQDFGIQDFGFDCFNDIEMNMLTQLDVKNDQTG

SEQ ID NO: 25688 - protein, 366 aa, Sinapis arvensis
SSNKTLVSPGDVFELGFFRTNSRWYLGMWYKKLPYRTYVWVANRDNPLSNSIGTLKITGNNLVILGHSNKSVWSTNLTRRNERSKVVAELLANGNFVMRDSNNNDASAFLWQSFDYPTDTLLPEMKLGYDLKKGLNRFLISWRSLDDPSSGNFSYKLENRKLPEFYLLSGVFELYRSGPWNGIRFSGIPDDQKLSYLVYDFTENTEEVAYTFRMTNNSLYSRLIVSSEGYIERQTWNPPIRDVERVLVFSLDSQCDAYRMCGPYSYCDVNTSPVCNCIQGFSPLNVEQWDQRSWSGGCIRRTRLSCSGDGFTRMKNIKLPETMMATVDRSIGVKECEKRCLGDCNCTAFANADIRNGGSGCVMWTG

SEQ ID NO: 25689 - protein, 364 aa, Raphanus raphanistrum subsp. raphanistrum
SSNKTLVSPGGVFEFGFFKLASSSCWYLGIWYKNIPERSYVWVANRDNPLHSSTGTLRISGTNLVLLDQSKNTVWSTNLTRRCVKSPVVAELFDNGNFVMRYSNNSDPSGYLWQSFDFPTDTLLPQMKLGFDLKTGPHRFLRSWRSPDDPASGNYTYKLETRGLPEFFLRSEDFLLYRTGPWNGIRFNGVPEMPRLLDNILTENKEEITYTFRMTNHSIYSKFIITHSGFFQLLTWTPKVQLWNVLWSIPNDQCDLYVLCGPYGYCDTKTSMCNCIKGFKPKGSQAWALGDMSQGCVRKTSLSCGGDGFIRLTKMKLPDTTYAIVDKLVGIKECKKRCLKDCNCTAFANADIRKGGSGCVMWTG

SEQ ID NO: 25690 - protein, 380 aa, Hirschfeldia incana
SSNKTLVSPGDVFELGFFKTTTRSSQDGSTDRWYLGIWYKTTSDHRTYVWIANRDNPLHNSIGTLKISHSSNLVLLDQSDTPVWSTNLTGVVKSPATAELLANGNFVLRGSYTIDLTHFMWQSFDFPVDTLLPEMKLGRNLIGPEHEKILTSWKSPTDPSSGDYSLILETEGFLHEFYLFKNEFKVYRTGPWNGVRFNGIPKKMQNWSYIVNNFIDNKEEVAYSFQVNNNHNIHSRFRMSSTGYLQVITWTKTVPQRNMFWSFPEDACDLYQVCGPYAYCDMHTTPMCNCIKGFVPKNAGRWDLRDMSGGCVRSSPLTCGEGDGFMVLGQMKMPETSEAFVEEMIGLEECSQKCVRDCNCTGFAIMDNMNGGSGCVMWTG

SEQ ID NO: 25691 - protein, 368 aa, Raphanus raphanistrum subsp. raphanistrum
SSNKTLVSPGNVFELGFFTTGSSSRWYLGIWYKKVSGRTYVWVANRDNPLSSSIGTLRFSNMNLVLLDQSNKSVWWTNLTRGNERSPVVAELLANGNFVIRDCSNNDASGFLWQSFDYPTDTLLPGMKLGYDAQKGLNRFLTSWRNSDDPSSGNISYKLDTQRGMPEFFLLKDGLRAHRSGPWNGVQFSGIPEDQKLSYMVYNFTENSEEVAYTFRMTNSSIYSRLKISFRRFLERWTTPTSIPWNLFWSAPVDLKCDVYKTCGPYSYCDLNTSPLCNCIQGFMPSNVQQWDLRDPSAGCIRRTRLSCSGDGFTRMKNMKLPETRMAIVDRSIGVKECEKRCLSDCNCTAFVQMRYPEWWVGMCDVDR

SEQ ID NO: 25692 - protein, 363 aa, Hirschfeldia incana
SSNKTLVSPGDVFELGFFKTTSSSRWYLGIWYKKVDFRTYVWVANRDNPLSSSIGTLKMSNMNLVLLDHSNKSVWSTSLTRGNERSPVVAELLANGNFVMRDSNNKDASGFLWQSFDFPTDTLLPEMKLGYDLKKGRNRFLTSWRNSDDPSSGEISYQLDTQTGMPEFYLLQSGVRVHRSGPWNGVRFSGMPGDQELNYMVYNFTENNEDVAYTFRMTNNSIYSILKTSSEGFLERLTWTPNSIAWNLFWSSPLENCDMYLICGPYSYCDVNTSPLCNCIQGFKPWNMQQWDLRDASVGVKRSTRLSCSGDGFTRMKNMKLPETKMAIVDRSIGVKECEKRCLMDCNCTAFANADIRNGGSGG

SEQ ID NO: 25693 - protein, 367 aa, Hirschfeldia incana
SSNKTLVSPGNVFELGFFRTTSSSRWYLGIWYKKLSNRTYVWVANRDNPLSNSIGTLKISNMNLVLLDHSNKSVWSTNLPRGNERYPVVAELLANGNFVMRYSDNNDASGFLWQSFDFPTDTLLPEMKLGYDLKTGLNRFLTAWRNLDDPSSGDYSYKLENRELPEFYLSKNGFQVHRSGPWNGVQFSGIPENQKLSYMVYNFTENSEEVAYTFRMTNNSIYSRLKVSSDGYLQRLTLIPESIIWNLFWSSPVDIRCDLYKTCGPYSYCDGNTSPLCNCIQGFDPWNMEQWDQRVSAGGCIRRTPLSCSGDGFTRMKNMKLPDTTMATVDRSIDVKECEKRCLSDCNCTAFANADIRSGGSGCVSGP

SEQ ID NO: 25694 - protein, 363 aa, Hirschfeldia incana
SSNKTLVSPGGVFEFGFFKIASSSRWYLGIWYKNIPKRSYVWVANRDNPLCSSTGTFKITGTNLVLLDQSKNTVWSTNLTRRCVKSPVVAELFDNGNFVMRYSDNNDPSGYLWQSFDFPTDTLLPEMKLGFDLKTGSHRFLRSWKSPDDPASGDYTYKLETRGRPECFLRSKDFLLYRTGPWNGFRFSGVPEMPQLLVNIFTENKEEITYTFRMTNHSTYSKLIVTPSGFFQLLTWTPKVQLWIVLWSVPKDQCDLYMLCGPYGYCDAKTSMCNCIKGFKPKASQAWASGDMSQGCVRRTRLTCGGDGFIRLTKMKLPDTMYATVDKLVGIKECKMRCLNNCKCTAFANADIQNGGSGCVMWT

SEQ ID NO: 25695 - protein, 369 aa, Hirschfeldia incana
SSNKTLVSPGNVFELGFFRTTSSSRWYLGIWYKKLSNRTYVWVANRDNPLSNSIGTLKISNMNLVLLDHSNKSVWSTSLTRGNERSPVVAELLANGNFVMRDSNNKDASGFLWQSFDFPTDTLLPEMKLGYDLKKGRNRFLTSWRNSDDPSSGEISYQLDTQTGMPEFYLLQSGVRVHRSGPWNGVRFSGMPGDQELNYMVYNFTENNEDVAYTFRMTNNSIYSILKTSSEGFLERLIWTPNSITLTLFWYLPLENQCDMYLICGRYAYCDVNTSPLCNCIQGFIPWNKQQWEMRDPSGGCKRSTRLSCSGDGFTRMKNMKLPETKMAIVDRSIGVKECEKRCLMDCNCTAFANADIRNGGSGCVMWTG

SEQ ID NO: 25696 - protein, 380 aa, Hirschfeldia incana
SSNKTLVSPGDVFELGNFKTTTRSSQDGSTDRWYLGIWYKTTSDHRTYVWIANRDNPLHNSIGTLKISHSSNLVLLDQSDTPVWSTNLTGVVKSPATAELLANGNFVLRGSYTIDLDHFMWQSFDFPVDTLLPEMKLGRNLIGPEHEKILTSWKSPTDPSSGDYSLILETEGFLHEFYLFKNEFKVYRTGPWNGVRFNGIPKKMQNWSYIVNNFIDNKEEVAYSFQVNNNHNIHSRFRMSSTGYLQVITWTKTVPQRNMFWSFPEDACDLYQVCGPYAYCDMHTTPMCNCIKGFVPKNAGRWDLRDMSGGCVRSSPLTCGEGDGFMVLGQMKMPETSEAFVEEMIGLEECSQKCVRDCNSTGFAIMDNMNGGSGCVMWTG

SEQ ID NO: 25697 - protein, 364 aa, Raphanus raphanistrum subsp. raphanistrum
SSNKTLVSPGGVFEFGFFKLASSSCWYLGIWYKNIPERSYVWVANRDNPLHSSTGTFRISGTNLVLLDQSKNTVWSTNLTRRCVKSPVVAELFDNGNFVMRYSNNSDPSGYLWQSFDFPTDTLLPQMKLGFDLKTGPHRFLRSWRSPDDPASGNYTYKLETRGLPEFFLRSEDFLLYRTGPWNGIRFNGVPEMPRLLDNILTENKEEITYTFRMTNHSIYSKFIITHSGFFQLLTWTPKVQLWNVLWSIPNDQCDLYVLCGPYGYCDTKTSMCNCIKGFKPKGSQAWALGDMSQGCVRKTSLSCGGDGFIRLTKMKLPDTTYAIVDKLVGIKECKKRCLKDCNCTAFANADIRKGGSGCVMWTG

SEQ ID NO: 25698 - protein, 157 aa, Apium graveolens
ILGFWILDVANNMMQGPCRALLADMSGHNHKKTRTANSYYSFFMAVGNVLGYAAGSYTDLYKVFPFTKTKACDVYCVNLKTCFIFAIILLLVLTTAAMTLVKERPLVLSHQSNADQDEEDEEEVSMPFFGQILSALGNLSRSMWMLIVVTSLNWIAW

SEQ ID NO: 25699 - protein, 227 aa, Paulownia kawakamii
MAREKIQIKKIDNATARQVTFSKRRRGIFKKAEELSVLCDADVGLIIFSSTGKLFEYASSSMKEILGRHNLHSKNLDKLEQPSLELQLVEDSNYSRLSKEVAERSHQLRRMRGEELQGLSIEKLQHLKKSLESGLSRVIEKKGEKIMKGDQSTSRKGKQLMEENERLRQQVADISNDCKNNAASDSENIVYDEGQSSESVNACNSVGPPQDYDSSDTSLKLGLPYSG

SEQ ID NO: 25700 - protein, 249 aa, Clostridium sp. TO-931
MNLVQDKIVIITGGTSGIGLCAAKIFMDNGATVSIFGKTQEEVDAAKAELKETHPDKEVLGFAPDLTNRDEVMAAVGAVAEKYGRLDVMINNAGVTSSNVFSRVSPEEFTYLMDINVTGVFHGAWAAYHCLKGEKKIIINTASVTGIHGSLSGVGYPTSKSAVVGFTQALGREIIRKNIRVVGVAPGVVNTPMVGNIPDEILDGYLSSFPMKRMLEPEEIANTYLFLASDLASGITATTVSVDGAYRPS

SEQ ID NO: 25701 - protein, 219 aa, Bradyrhizobium japonicum
MDFVDSCYLVKHAKGWFLWDTGIADSVAAMPNGLVPADPKAVTWRRPKTLAAQLEQLGVKPDDVKAMAVSNTHPDHSGNVELFPQAVLYVQKAEYDWPAANNEPALQAFASRRSSSRVTRTCSADGSVTILSTPGHTPGHQSLLVKLPKTGAVILSGDAVHFRDNWDNRRVPSMNVNKDQSAASMQKIADTLSREKAQLWINHDKAQRDSQKMAPEFYD

SEQ ID NO: 25702 - protein, 360 aa, Ancylostoma caninum
MLKFLKNKTSDEGPSSKESKSSSGFKEFLEKAREDFKQRWENPAQNTATLDDFDRIKTLGTGSFGRVMLVKHKQTGNYFAMKILDKQKVVKLKQVEHTLNEKRILQAIDFPFLVNMQYSFKDNSNLYMVLEFISGGEMFSHLRRIGRFSEPHSRFYAAQIVLAFEYLHSLDLIYRDLKPENLLIDSTGYLKITDFGFAKRVKGRTWTLCGTPEYLAPEIILSKGYNKAVDWSALGVLIYEMAAGYAPFFADQPIQIYEKIVSGKVKFPSHFSNELKDLLKNLLQVDLTKRFGNLKNGVADIKNHKWFGSTDWIAIYQRKVEAPFLPKCRGPGDASNFDDYEEEPLRISGTEKCSKEFAEF

SEQ ID NO: 25703 - protein, 804 aa, Arabidopsis thaliana
MASFFDLVYHKRIGFLNKFLSFWVFWVCLVRYVAHGKGILQSHQLIDEFLKTVKVDGTLEDLNKSPFMKVLQEAIVLPPFVALAIRPRPGVREYVRVNVYELSVDHLTVSEYLRFKEELVNGHANGDYLLELHFEPFNATLPRPTRSSSIGNGVQLVNRHLSSIMFRNKESMEPLLEFLRTHKHDGRPMMLNDRIQNIPILQGALARAEEFLSKLPLATPYSEFEFELQGMGFERGWGDTAQKVSEMVHLLLDILQAPDPSVLETFLGRIPMVFNVVILSRYGYFAQANVLGLPDTGAQVVYILDQVRALENEMLLRIQKQGLEVIPKILIVTRLLPEAKGTTCNQRLERVSGTEHAHILRIPFRTEKGILRKWISRFDVWPYLETFAEDASNEISAELQGVPNLIIGNYSDGNLVASLLASKLGVIQCNIAHALEKTKYPESDIYWRNHEDKYHFSSQFTADLIAMNNADFIITSTYQEIAGSKNNVGQYESHTAFTMPGLYRVVHGIDVFDPKFNIVSPGADMTIYFPYSDKERRLTALHESIEELLFSAEQNDEHVGLLSDQSKPIIFSMARLDRVKNLTGLVECYAKNSKLRELANLVIVGGYIDENQSRDREEMAEIQKMHSLIEQYDLHGEFRWIAAQMNRVRNGELYRYIADTKGVFVQPAFYEAFGLTVVESMTCALPTFATCHGGPAEIIENGVSGFHIDPYHPDQVAGSLALFETCNTNPNHWVKISEGGLKRIYERYTWKKYSERLLTLAGVYAFWKHVSKLERRETRRYLEMFYSLKFRDLANSIPLATDEN

SEQ ID NO: 25704 - protein, 244 aa, Arabidopsis thaliana
MAVATHCFTSPCHDRIRFFSSDDGIGRLGITRKRINGTFLLKILPPIQSADLRTTGGRSSRPLSAFRSGFSKGIFDIVPLPSKNELKELTAPLLLKLVGVLACAFLIVPSADAVDALKTCACLLKGCRIELAKCIANPACAANVACLQTCNNRPDETECQIKCGDLFENSVVDEFNECAVSRKKCVPRKSDLGEFPAPDPSVLVQNFNISDFNGKWYITSGLNPTFDAFDCQLHEFHTEGDNKL

SEQ ID NO: 25705 - protein, 170 aa, Vicia faba
MEAMLITRSTVVCHFSKPLPNTPSLSLHKPSRVCLASASNHSNASYRIAPKTRRGVVVRAAESISEGVEEIKKAALDANEKAKEAAGSIADKAKEDTDKALAAGESAGEKAKGFASDAQDKTAEALGSVSDKINEGIETASDKAAEATKALKKEGEKAEKAADERGRMPR

SEQ ID NO: 25706 - protein, 317 aa, Mus musculus
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLIIQQVFDNGSIYNPEVLDITEQALHSRFLEGVRNVASVCLQIGYPTVASVPHSIINGYKRVLALSVETEYTFPLTEKVKAFLADPSAFAAAAPAAAATTAAPAAAAAPAKAEAKEESEESDEDMGFGLFD

SEQ ID NO: 25707 - protein, 491 aa, Mus musculus
MPRERDSTDHSNMKEEGGSDLSVRSRKRKANVAVFLQDPDEEIAKIDKTVKSEDSSQPWDDNSACVDPCSFIPTPNKEEDNELEYPRTAFQPRKIRPPRASPLPVLNWGNREEVWRIMLNKEKTYLRDEHFLQRHPLLQARMRAVLLDWLMEVCEVYKLHRETFYLAQDFFDRYMASQQNIIKTLLQLIGISALFIASKLEEIYPPKLHQFAYVTDGACSGDEILTMELMMMKALKWRLSPLTIVSWLNVYVQVAYVNDTGEVLMPQYPQQVFVQIAELLDLCVLDVGCFRFPYGVLAASALYHFSSLELMQKVSGYQWCDIEKCVKWMVPFAMVIREMGSSKLKHFRGVPMEDSHNIQTHTNSLDLLDKAQAKKAILSEQNRISPPPSVVLTPPPSSKKAEQRAGDRMTKPAIASKDSGVEAAAWSSLCCLGGQEPLQMLCSMERCISSGAAGVCKMPWMEVLLLNARCFNYRVKYTSHLQNTTECSRSC

SEQ ID NO: 25708 - protein, 355 aa, Squalus acanthias
MGCTISAEDKAAAERSKMIDKNLREDGEKAAREVKLLLLGAGESGKSTIVKQMKIIHEDGYSEEECRQYKAVVYSNTIQSIMAIIKAMGNLKVDFGESGRADDARQLFALSGTAEEQGILPEDLANVIRRLWADAGVQACFGRSREYQLNDSAAYYLNDLERIARSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITKSPLTICFPEYSGANEYDAAAGYIQTKFEDLNKRKDTKEIYTHFTCATDTKNVQFVFDAVTDVIIKNNLKDCGLF

SEQ ID NO: 25709 - protein, 221 aa, Mus musculus
MEAGGVADSFLSSACVLFTLGMFSTGLSDLRHMQRTRSVDNIQFLPFLTTDVNNLSWLSYGVLKGDGTLIIVNSVGAVLQTLYILAYLHYSPQKHGVLLQTATLLAVLLLGYGYFWLLVPDLEARLQQLGLFCSVFTISMYLSPLADLAKIVQTKSTQRLSFSLTIATLFCSASWSIYGFRLRDPYIAVPNLPGILTSLIRLGLFCKYPPEQDRKYRLLQT

SEQ ID NO: 25710 - protein, 282 aa, Mus musculus
MSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKAEHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 25711 - protein, 282 aa, Mus musculus
MSRQAATALSTGTSKCPPSQRVPALTDTTASNNDLASLFECPVCFDYVLPPILQCQSGHLVCSNCRPKLTCCPTCRGPLGSIRNLAMEKVANSVLFPCKYSASGCEITLPHTKKAEHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 25712 - protein, 325 aa, Mus musculus
MSRPSSTGPSANKPCSKQPPPPQTPHAPSPAAPPAAATISAAGPGSSAVPAAAAVISGPGAGGGADPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEETVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCQ

SEQ ID NO: 25713 - protein, 510 aa, Mus musculus
MPSGFQQIGSDVKDGEPPRQRVTGTLVLAVFSAVLGSLQFGYNIGVINAPQKVIEQSYNATWLGRQGPGGPDSIPQGTLTTLWALSVAIFSVGGMISSFLIGIISQWLGRKRAMLANNVLAVLGGALMGLANAVASYEILILGRFLIGAYSGLTSGLVPMYVGEIAPTHLRGALGTLNRLAIVIGILVAQVLGLESMLGTATLWPLLLALTVLPALLQLILLPFCPESPRYLYIIRNLEGPARKSLKPLTGWADVSDALAELKDEKRKLERERPMSLLQLLGSRTHRQPLIIAVVLQLSQQLSGINAVFYYSTSIFESAGVGQPAYATIGAGVVNTVFTLVSVLLVERAGRRTLHLLGLAGMCGCAILMTVALLLLERVPAMSYVSIVAIFGFVAFFEIGPGPIPWFVAELFSQGPRPAAMAVAGFSNWTCNFIVGMGFQYVADRMGPYVFLLFAVLLLGFFIFTFLKVPETRGRTFDQISAAFRRTPSLLEQEVKPSTELEYLGPDEND

SEQ ID NO: 25714 - protein, 299 aa, Mus musculus
MGKEEEIARIARRLDKMVTRKNAEGAMDLLRELKNMPITLHLLQSTRVGMSVNALRKQSSDEELIALAKSLIKSWKKLLDVSDGKSRNQGRGTPLPTSSSKDASRTTDLSCKKPDPPRTPSTPRITTFPQVPITCDAVRNKCREMLTLALQTDHDHVAVGVNCEHLSSQIEECIFLDVGNTDMKYKNRVRSRISNLKDAKNPGLRRNVLCGAITPQQIAVMTSEEMASDELKEIRKAMTKEAIREHQMARTGGTQTDLFTCNKCRKKNCTYTQVQTRSSDEPMTTYVVCNECGNRWKFC

SEQ ID NO: 25715 - protein, 623 aa, Mus musculus
MEGYHKPDQQKLQALKDTANRLRISSIQATTAAGSGHPTSCCSAAEIMAVLFFHTMRYKALDPRNPHNDRFVLSKGHAAPILYAVWAEAGFLPEAELLNLRKISSDLDGHPVPKQAFTDVATGSLGQGLGAACGMAYTGKYFDKASYRVYCMLGDGEVSEGSVWEAMAFAGIYKLDNLVAIFDINRLGQSDPAPLQHQVDIYQKRCEAFGWHTIIVDGHSVEELCKAFGQAKHQPTAIIAKTFKGRGITGIEDKEAWHGKPLPKNMAEQIIQEIYSQVQSKKKILATPPQEDAPSVDIANIRMPTPPSYKVGDKIATRKAYGLALAKLGHASDRIIALDGDTKNSTFSELFKKEHPDRFIECYIAEQNMVSIAVGCATRDRTVPFCSTFAAFFTRAFDQIRMAAISESNINLCGSHCGVSIGEDGPSQMALEDLAMFRSVPMSTVFYPSDGVATEKAVELAANTKGICFIRTSRPENAIIYSNNEDFQVGQAKVVLKSKDDQVTVIGAGVTLHEALAAAESLKKDKISIRVLDPFTIKPLDRKLILDSARATKGRILTVEDHYYEGGIGEAVSAAVVGEPGVTVTRLAVSQVPRSGKPAELLKMFGIDKDAIVQAVKGLVTKG

SEQ ID NO: 25716 - protein, 422 aa, Mus musculus
MSLHFLYYCSEPTLDVKIAFCQGFDKHVDVSSIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRSYIDQWNKVIEQLGTPCPEFMKKLQPTVRNYVENRPKYAGLTFPKLFPDSLFPADSEHNKLKASQARDLLSKMLVIDPVKRISVDDALQHPYINVWYDPAEVEAPPPQIYDKQLDEREHTIEEWKELIYKEVMNSEEKTKNGVVKSQPSPSAQVQQ

SEQ ID NO: 25717 - protein, 515 aa, Mus musculus
MAAYNGGTSAAAAGHHHHHHHHLPHLPPPHLHHHHHPQHHLHPGSAAAVHPVQQHTPSAAAAAAAAAAAAAMLNPGQQQPYFPSPAPGQAPGPAAAAPAQVQAAAAATVKAHHHQHSHHPQQQLDIEPDRPIGYGAFGVVWSVTDPRDGKRVALKKMPNVFQNLVSCKRVFRELKMLCFFKHDNVLSALDILQPPHIDYFEEIYVVTELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 25718 - protein, 274 aa, Mus musculus
MAARRALIVLAHSEKTSFNYAMKEAAVEALKKRGWEVLESDLYAMNFNPIISRNDITGELKDSKNFQYPSESSLAYKEGRLSPDIVAEHKKLEAADLVIFQFPLQWFGVPAILKGWFERVLVAGFAYTYAAMYDNGPFQNKKTLLSITTGGSGSMYSLQGVHGDMNVILWPIQSGILRFCGFQVLEPQLVYSIGHTPPDARMQILEGWKKRLETVWEETPLYFAPSSLFDLNFQAGFLMKKEVQEEQKKNKFGLSVGHHLGKSIPADNQIKARK

SEQ ID NO: 25719 - protein, 451 aa, Mus musculus
MNKMKNFKRRLSLSVPRPETIEESLAEFTEQFNQLHTQTNEDGTDEPEQLSPGMQYQQRQNQRRFSMEDLNKRLSLPMDIRLPQEFLQKLQLENPGLPKPLTRMSRRASLSDIGFGKLETYVKLDKLGEGTYATVFKGRSKLTENLVALKEIRLEHEEGAPCTAIREVSLLKDLKHANIVTLHDLIHTDRSLTLVFEYLDSDLKQYLDHCGNLMNMHNVKIFMFQLLRGLAYCHHRKILHRDLKPQNLLINERGELKLADFGLARAKSVPTKTYSNEVVTLWYRPPDVLLGSTEYSTPIDMWGVGCILYEMATGKPLFPGSTVKEELHLIFRLLGTPTEESWPGVTSISEFRAYNFPRYLPQPLLSHAPRLDTEGINLLSSLLLYESKSRMSAEAALNHPYFQSLGDRVHQLHDTASIFSLKEIQLQKDPGYRGLAFQHPGRGKSRRQSIF

SEQ ID NO: 25720 - protein, 271 aa, Mus musculus
MTCPQPRIPGPRLGEDMEAYVLVPAPRDHMVQWRIVRNKHGMDKGMFPSYYLYLEGEDGVAHFLLAGRKRKRSKTSNYLISLDPKDMSRNGSNFVGKVRSNVLGTKFTIFDNGVNPERSYWVPDSARIREELGVVCYETNVLGFRGPRKMTVILPGMDSRKQRMKVQPQNDQDSILSRVQKGAGHGLLLLQNKAPSWSDESGAYVLNFHGRVSRASVKNFQIVHPDEPDHLVLQFGRVAPNIFTMDFRYPLCPLQAFAICLSSFDGKLACE

SEQ ID NO: 25721 - protein, 474 aa, Mus musculus
MPGTALSPLLLLLLLSWASRNEAAPDQDEIDCLPGLAKQPSFRQYSGYLRASDSKHFHYWFVESQNDPKNSPVVLWLNGGPGCSSLDGLLTEHGPFLIQPDGVTLEYNPYAWNLIANVLYIESPAGVGFSYSDDKMYVTNDTEVAENNYEALKDFFRLFPEYKDNKLFLTGESYAGIYIPTLAVLVMQDPSMNLQGLAVGNGLASYEQNDNSLVYFAYYHGLLGNRLWTSLQTHCCAQNKCNFYDNKDPECVNNLLEVSRIVGKSGLNIYNLYAPCAGGVPGRHRYEDTLVVQDFGNIFTRLPLKRRFPEALMRSGDKVRLDPPCTNTTAPSNYLNNPYVRKALHIPESLPRWDMCNFLVNLQYRRLYQSMNSQYLKLLSSQKYQILLYNGDVDMACNFMGDEWFVDSLNQKMEVQRRPWLVDYGESGEQVAGFVKECSHITFLTIKGAGHMVPTDKPRAAFTMFSRFLNKEPY

SEQ ID NO: 25722 - protein, 774 aa, Mus musculus
MSSARTPLPTLNERDTEQPTLGHLDSKPSSKSNMLRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVLHVQYCHQKFIVHRDLKAENLLLDADMNIKIADFGFSNEFTFGNKLDTFCGSPPYAAPELFQGKKIDGPEVDVWSLGVILYTLVSGSLPFDGQNLKELRERVLRGKYRIPFYMSTDCENLLKKFLILNPSKRGTLEQIMKDRWMNVGHEDDELKPYVEPLLTTGPRDRVDGVNGLHTEEIQDSLVGQRYNEVMATYLLLGYKSSEPEGDTITLKPRPSADLTNSSAPSPSHKVQRSVSANPKQRRSSDQAVPAIPTSNSYSKKTQSNNAENKRPEEETGRKASSTAKVPASPLPGLDRKKTTPAPSTNSVLSTSTNRSRNSPLLDRASLGQASIQNGKDSLTMPGSRASTASASAAVSAARPRQHQKSMSASVHPNKASGLPPTESNCEVPRPSTAPQRVPVASPSAHNISSSSGAPDRTNFPRGVSSRSTFHAGQLRQVRDQQNLPYGVTPASPSGHSQGRRGASGSIFSKFTSKFVRRNLNEPESKDRVETLRPHVVGSGGTDKDKEEFREAKPRSLRFTWSMKTTSSMEPNEMMREIRKVLDANSCQSELHERYMLLCVHGTPGHENFVQWEMEVCKLPRLSLNGVRFKRISGTSMAFKNIASKIANELKL

SEQ ID NO: 25723 - protein, 750 aa, Mus musculus
MRKMDIASPPTSKCITYWKRKVKSEYMRLRQLKRLQANMGAKALYVANFAKVQEKTQILNEEWKKLRVQPVQPMKPVSGHPFLKKCTIESIFPGFDSQDMLMRSLNTVALVPIMYSWSPLQQNFMVEDETVLCNIPYMGDEVKEEDETFIEELINNYDGKVHGEEEMIPGSVLISDAVFLELVDALNQYSDEEEDGHNDPSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHPVVSASCSNASASAMAETKEGDSDRDTGNDWASSSSEANSRCQTPTKQKASPAPAQLCVVEAPSEPVEWTGAEESLFRVFHGTYFNNFCSIARLLGTKTCKQVFQFAVKESLILKLPTDELMNPAQKKKRKHRLWAAHCRKIQLKKDNNSTQVYNYQPCDHPDRPCDSTCPCIMTQNFCEKFCQCSPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVF

SEQ ID NO: 25724 - protein, 746 aa, Mus musculus
MGQTGKKSEKGPVCWRKRVKSEYMRLRQLKRFRRADEVKTMFSSNRQKILERTETLNQEWKQRRIQPVHIMTSVSSLRGTRECSVTSDLDFPAQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPDEREEKQKDLEDNRDDKETCPPRKFPADKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTISVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPVPTEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEDDRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 25725 - protein, 354 aa, Mus musculus
MTDRSPFETDMLTLTRYVMEKGRQAKGTGELTQLLNSMLTAIKAISSAVRKAGLANLYGISGSVNVTGDEVKKLDVLSNSLVINMLQSSYSTCVLVSEENKEAVITAQERRGKYVVCFDPLDGSSNIDCLASIGTIFAIYRKTTEDEPSEKDALQPGRNIVAAGYALYGSRTLVALSTGQGVDLFMLDPALGEFVLVEKDVRIKKKGKIFSLNEGYAKYFDAATAEYVQKKKFPEDGSEPYGARYVGSMVADVHRTLVYGGIFMYPANQKSPNGKLRLLYECNPVAYIIEQAGGMATTGTQPVLDVKPESIHQRVPLILGPLRMCKSISAVCRETRQAGSEPEPMSPLPFVFVN

SEQ ID NO: 25726 - protein, 381 aa, Homo sapiens
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHQLEDVQRYLVQCFDRKRRNRSKPLFHHFTTAIDTENVRFVFHAVKDTILQENLKDIMLQ

SEQ ID NO: 25727 - protein, 355 aa, Mus musculus
MGCTVSAEDKAAAERSKMIDKNLREDGEKAAREVKLLLLGAGESGKSTIVKQMKIIHEDGYSEEECRQYRAVVYSNTIQSILAIVKRMGNLQIDFADPQRADDARQLFALSCAAEEQGMLPEDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITQSSLTICFPEYTGANKYDEAASYIQSKFEDLNKRKDTKEIYTHFTCATDTKNVQFVFDAVTDVIIKNNLKDCGLF

SEQ ID NO: 25728 - protein, 359 aa, Mus musculus
MTLESIMACCLSEEAKEARRINDEIERHVRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPSYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 25729 - protein, 350 aa, Mus musculus
MGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFDRASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFSEKIKKAHLSICFPDYDGPNTYEDAGNYIKVQFLELNMRRDVKEIYSHMTCATDTQNVKFVFDAVTDIIIKENLKDCGLF

SEQ ID NO: 25730 - protein, 354 aa, Mus musculus
MGSGISAEDKELARRSKELEKKLQEDADKEAKTVKLLLLGAGESGKSTIVKQMKIIHQDGYSPEECLEFKSVIYGNVLQSILAIIRAMSTLGIDYAEPSCADAGRQLNNLADSTEEGTMPPELVDVIRKLWKDGGVQACFDRAAEFQLNDSASYYLNQLDRITDPNYLPNEQDVLRSRVKTTGIIETKFSVKDLNFRMFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYEDAGNYIKSQFLDLNMRKDVKEIYSHMTCATDTQNVKFVFDAVTDIIIKENLKDCGLF

SEQ ID NO: 25731 - protein, 421 aa, Mus musculus
MHRQSSKSGVALPPVGQGPDACQMLSRAQLGQDPPQRTVLGVLTENEQYRRTCGQEITAIRCFSGSENVFPAAGKKVLSDHGVNEPAKRGFDIYMDDPEQGDRDTCSGKEGIIFEDVYEVDTSMLKSDLHFLLDFNTVSPMLVDPTTHAQSEEATDFGSDVINVTEYAEEIHRYLPEAEVRHRPKAHYMRKQPDITEGMRAILVDWLVEVGEEYKLRTETLYLAVNFLDRFLSCMSVLRGKLQLVGTAAILLASKYEEIYPPDVDEFVYITDDTYTKRQLLRMEHLLLKVLAFDLTVPTTNQFLLQYLRRQGVCIRTENLAKYVAELSLLEADPFLKYLPSLVAAAAYCLANYIVNRHFWPETLAAFTGYSLNEIVPCLSELHKACLSIPHRPQQAIREKYKASKYLHVSLMEPPVVLPLQ

SEQ ID NO: 25732 - protein, 398 aa, Mus musculus
MALLRRPTVSSDLKNIDTEVIPKAKSHVTIRRAVLEEIGNKVRNRTTQVAKKPQNTKVPALSTKVTNVNKQPKPTASVKPVQMEALAPKDRPPAPEDVSMKEESLCQAFSDALLCKIEDIDNEDRENPQLCSDYVKDIYQYLRQLEVLQSINPHFLDGRDINGRMRAILVDWLVQVHSKFRLLQETLYMCIGIMDRFLQAQLVCRKKLQVVGITALLLASKYEEMFSPNIEDFVYITDNAYTSSQIREMETLILKELKFELGRPLPLHFLRRASKAGEVDVEQHTLAKYLMELTLVDYDMVHYHPSQVAAAASCLSQKVLGQGKWNLKQQYYTGYMESEVLEVMQHMAKNVVKVNDNRTKFIAVKNKYASSRLLKIKHDPQLNSKIIKDLVSPLLGSP

SEQ ID NO: 25733 - protein, 295 aa, Mus musculus
MEHQLLCCEVETIRRAYPDTNLLNDRVLRAMLKTEETCAPSVSYFKCVQKEIVPSMRKIVATWMLEVCEEQKCEEEVFPLAMNYLDRFLSLEPLKKSRLQLLGATCMFVASKMKETIPLTAEKLCIYTDNSIRPEELLQMELLLVNKLKWNLAAMTPHDFIEHFLSKMPEADENKQTIRKHAQTFVALCATDVKFISNPPSMVAAGSVVAAMQGLNLGSPNNFLSCYRTTHFLSRVIKCDPDCLRACQEQIEALLESSLRQAQQNVDPKATEEEGEVEEEAGLACTPTDVRDVDI

SEQ ID NO: 25734 - protein, 292 aa, Mus musculus
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPAMTKLPDYKPYPMYPATTSLVNVVPKLNATGRDLLQNLLKCNPVQRISAEEALQHPYFSDFCPP

SEQ ID NO: 25735 - protein, 172 aa, Mus musculus
MASDEGKLFVGGLSFDTNEQALEQVFSKYGQISEVVVVKDRETQRSRGFGFVTFENIDDAKDAMMAMNGKSVDGRQIRVDQAGKSSDNRSRGYRGGSAGGRGFFRGGRSRGRGFSRGGGDRGYGGGRFESRSGGYGGSRDYYASRSQGGSYGYRSSGGSYRDSYDSYATHNE

SEQ ID NO: 25736 - protein, 391 aa, Mus musculus
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTVREAMEHPFFYTVVKNQARMSSTSMAGGSTPVSSANMMSGISSVPSPSPLGPLAGSPVIAAANSLGIPVQAAAGAQQ

SEQ ID NO: 25737 - protein, 448 aa, Mus musculus
MSTFRQEDVEDHYEMGEELGSGQFAIVRKCQQKGTGMEYAAKFIKKRRLPSSRRGVSREEIEREVSILREIRHPNIITLHDVFENKTDVVLILELVSGGELFDFLAEKESLTEDEATQFLKQILDGVHYLHSKRIAHFDLKPENIMLLDKHAASPRIKLIDFGIAHRIEAGSEFKNIFGTPEFVAPEIVNYEPLGLEADMWSIGVITYILLSGASPFLGETKQETLTNISAVNYDFDEEYFSSTSELAKDFIRRLLVKDPKRRMTIAQSLEHSWIKVRRREDGARKPERRRLRAARLREYSLKSHSSMPRNTSYASFERFSRVLEDVAAAEQGLRELQRGRRQCRERVCALRAAAEQREARCRDGSAGLGRDLRRLRTELGRTEALRTRAQEEARAALLGAGGLKRRLCRLENRYDALAAQVAAEVQFVRDLVRALEQERLQAECGVR

SEQ ID NO: 25738 - protein, 249 aa, Citrus unshiu
TFTEDVATEIIQELQCKPDLIIGNYSDGNIVASLLAHKLDVTQCTIAHALELTKYPDSDINWKKLDDKYHFSCQFTADLFAMNRTDFIITSTFQEIAGSKDTVGQYESHTAFSLPGLYRVVNGIDAFDPKFNIVSPGADMTIYFPYMEEKRRLKHFHSEIEELLYSPVENKEHLCVLKDSSKPILFTMARLDRVKNLTGLVEWYGKNAKLRELVNLVVVGGDRRKESKDLEEQAEMKKMYGLVDTYKLN

SEQ ID NO: 25739 - protein, 811 aa, Citrus unshiu
MAAPKLSRIPSIRERVEDTLSVHRNELVSLLSRYVAQGKGILQPHVLIDELDNIFGDDEGRQNLRDGPFSEVIKSAQEAIVLPPFVAIAVRPRPGVWEYVRVNVYELSVEQLSVSEYLHFKEELVDAAFNERFVLELDFEPFNATFPRPNRSSSIGNGVQFLNRHLSSSMFRNKDCLEPLLDFLRAHKYKGHLLMLNDRIQSISRLQSSLSKAEDHLSKLPPDTPFSQFEYVLQGMGFEKGWGDTAEHVLEMMHLLLDILQAPDPSTLEKFLGRLPMVFNVVILSPHGYFGQANVLGLPDTGGQVVYILDQVRALENEMLLRIKRQGLDISPKILIVTRLIPDAKGTTCNQRLERVSGTEHTHILRVPFRSEKGILRQWISRFDVWPYLETFTEDVGSEITAELQGFPDFIIGNYSDGNLVASLLAYKMGITQCTIAHALEKTKYPDSDIYWKKFDEKYHFSCQFTADLIAMNNADFIITSTYQEIAGTKNTVGQYESHTAFTLPGLYRVVHGIDVFDPKFNIVSPGADMDIYFPYSEKQKRLTALHGSIEQLLFDPEQNDEHVGTLSDRSKPIVFSMARLDHVKNMTGLVECYGKNSRLRELVNLVVVAGYIDVNKSKDREEIAEIEKMHELMKTYKLDGQFRWIAAQTNRARNGELYRYIADTKGAFVQPAFYEAFGLTVVEAMTCGLPTFATCHGGPAEIIEHGASGFHIDPYHPDQAAELMADFFGKCKENPSHWKKISDGGLKRIYERYTWKIYSERLMTLAGVYGFWKYVSKLERRETRRYLEMFYILKFRDLVKSVPLASENQH

SEQ ID NO: 25740 - protein, 805 aa, Citrus unshiu
MAERALTRVHSLRERLDETLSAHRNEILALLSRIEGKGKGILQNHQLIAEFESISEENRKHLTEGAFGEVLRATQEAIVLAPWVALAVRPRPGVWEYIRVNVHALVVEELLVAEYLHFKEELVDGGSNGNFVLELDFEPFNASFPRPTLSKSIGNGVEFLNRHLSAKLFHDKESMHPLLEFLRVHCHKGKNMMLNDRIQNLNSLQHVLRKAEEYLTTVVPETPFSELALRFQEIGLERGWGDTAERALEMIQLLLDLLEAPDPCTLETFLGRIPMVFNVVILTPHGYFAQDDVVGYPDTGGQVVYILDQVRALEDEMLLRIKQQGLDITPQILIITRLLPDAVGTTCGQRLEKVYGTKYSDILRVPFRTEKGVVRKWISRFEVWPYLETYTEDVAVEIAKELQGKPDLIIGNYSDGNIVASLLAHKLGVTQCTIAHALEKTKYPDSDIYWKNLDDKYHFSCQFTADLIAMNHTDFIITSTFQEIAGSKDTVGQYESHTAFTLPGLYRVVHGIDVFDPKFNIVSPGADMSIYFPYTEEKRRLKSFHPEIEELLYSDVENKEHLCVLKDRNKPILFTMARLDRVKNLTGLVEWYGKNAKLRELVNLVVVGGDRRKESKDLEEQAEMKKMYSLIDQNKLNGQFRWISSQMNRVRNGELYRYICETKGAFVQPALYEAFGLTVVEAMTCGLPTFATCKGGPAEIIVNGKSGYHIDPYHGEQAAEILVDFFEKCKADPSYWDKISLGGLKRIEEKYTWKIYSQRLLTLTGVYGFWKHVSNLDRLESRRYLEMFYALKYRKLAESVPLAVE

SEQ ID NO: 25741 - protein, 508 aa, Nicotiana tabacum
MMSTAAVIGLSAGKRLLSSSFYYSDLNEKLTCTSDHSLPCHHVPSIKNVITAKKSSDYSPSCVSSRKSQSAKSLKEHVDITADPSDVPSWFEMYEQLQNESDDEDESVEVLLLLQKSMLEKQWNLSLEQTLTASPQHEKKSKKMHITCSGTSARRRRMDSRQRVLDRHSSATPTSAAKPLRSIIGPELLQNRLKGYVKGVVSEELLTHAEVLQLSKKIQVGLYLEEQKSRLKERLGCEPSDDQLAVSLKMSRTDLQSTLIECSLARERLAMSNVRLVMSIAQRYDNVGAEMADLVQGGLIGLLRGIEKFDPSKGYKISTYVYWWIRQGVSRALVENSRTLRLPTYLHERLSLIRNAKARLEEKGITPSVNNIAASLNMSQKKVRNATEASSKMYSLDREAFPSLNGLPGETLHSYIADNHLENNPWHGVDVWALKDEVNNLISSTLRDREREIIRLYYGLDNECLTWEDISKRIGLSRERVRQVGLVALEKLKHAARKRQLDAMLIKQ

SEQ ID NO: 25742 - protein, 502 aa, Nicotiana tabacum
MMAIIGLSAGNRILSSSFYYSVLTEKFCVSDHALPCHHFPSPKNVINAKNSSNYSPSYVSNRKKQSVKALKEHVDIASNRDSDTEPWVQMFKQLQNGSCSEEDSVEVLLLLQKSMLEKQWNLSAEKAMTNENNCKKKMQITCSGTSARRRRMDTRKRDLLPKNSATSDSSSKRLRSVIGPELLQNRSKGYINGVVGQELLTHTEVVQLSKKIKFGLYLEEQKSRLKERLGCEPSDDQLAISLKISRADLRSTLIECSLAREKLAMSNVRLVMSIAQRYDTNGTEMADLIQGGLIGLLRGIEKFDHSRGFKISTYVYWWIRQGVSRALVENSRTLRLPIHLHERLSLIRNAKIKLKENGITPSIEKIAECLNMSQKKVRNATEASSKVFSLDREAFPSLNGLPGETLHSYIADNRLENIPWHGVDEWMLKDEVNNLISSTLREREREIVRLYYGLDNECLTWEDISRRIGLSRERVRQVGLVALEKLKHAARKRRLDAMLVKH

SEQ ID NO: 25743 - protein, 811 aa, Citrus unshiu
MAAPKLSRIPSIRERVEDTLSVHRNELVSLLSRYVAQGKGILQPHVLIDELDNIFGDDEGRQNLRDGPFSEVIKSAQEAIVLPPFVAIAVRPRPGVWEYVRVNVYELSVEQLSVSEYLHFKEELVDASFNERFVLELDFEPFNATFPRPNRSSSIGNGVQFLNRHLSSSMFRNKDCLEPLLDFLRAHKYKGHLLMLNDRIQSISRLQSSLSKAEDHLSKLPPDTPFSQFEYVLQGMGFEKGWGDTAEHVLEMMHLLLDILQAPDPSTLEKFLGRLPMVFNVVILSPHGYFGQANVLGLPDTGGQVVYILDQVRALENEMLLRIKRQGLDISPKILIVTRLIPDAKGTTCNQRLERVSGTEHTHILRVPFRSEKGILRQWISKFDVWPYLETFTEDVGSEITAELQGFPDFIIGNYSDGNLVASLLAYKMGITQCTIAHALEKTKYPDSDIYWKKFDEKYHFSCQFTADLIAMNNADFIITSTYQEIAGTKNTVGQYESHTAFTLPGLYRVVHGIDVFDPKFNIASPGADMDIYFPYSEKQKRLTALHGSIEQLLFDPEQNDEHVGTLSDQSKPIVFSMARLDHVKNMTGLVECYGKNSRLRELVNLVVVAGYIDVNKSKDREEIAEIEKMHELMKTYKLDGQFRWIAAQTNRARNGELYRYIADTKGAFVQPAFYEAFGLTVVEAMTCGLPTFATCHGGPAEIIEHGASGFHIDPYHPDQAAELMADFFGKCKENPSHWKKISDGGLKRIYERYTWKIYSERLMTLAGVYGFWKYVSKLERRETRRYLEMFYIPKFRDLVKSVPLASENQH

SEQ ID NO: 25744 - protein, 805 aa, Citrus unshiu
MAERALTRVHSLRERLDETLSAHRNEILALLSRIEGKGKGILQNHQLIAEFESISEENRKHLTEGAFGEVLRATQEAIVLPPWVALAVRPRPGVWEYIRVNVHALVVEELLVAEYLHFKEELVDGGSNGNFVLELDFEPFNASFPRPTLSKSIGNGVEFLNRHLSAKLFHDKESMHPLLEFLRVHCHKGKNMMLNDRIQNLNSLQHVLRKAEEYLTTVAPETPFSELALRFQEIGLERGWGDTAERALEMIQLLLDLLEAPDPCTLETFLGRIPMVFNVVILTPHGYFAQDDVLGYPDTGGQVIYILDQVRALEDEMLLRIKQQGLDITPQILIITRLLPDAVGTTCGQRLEKVYGTKYSDILRVPFRTEKGVVRKWISRFEVWPYLETYTEDVAVEIAKELQGKPDLIIGNYSDGNIVASLLAHKLGVTQCTIAHALEKTKYPDSDIYWKNLDDKYHFSCQFTADLIAMNHTDFIITSTFQEIAGSKDTVGQYESHTAFTLPGLYRVVHGIDVFDPKFNIVSPGADMSIYFPYTEEKRRLKSFHPEIEELLYSDVENKEHLCVLKDRNKPILFTMARLDRVKNLTGLVEWYGKNAKLRELVNLVVVGGDRRKESKDLEEQAEMKKMYSLIDQYKLNGQFRWISSQMNRVRNGELYRYICDTKGAFVQPALYEAFGLTVVEAMTCGLPTFATCKGGPAEIIVNGKSGYHIDPYHGEQAAEILVDFFEKCKADPSYWDKISLGGLKRIEEKYTWKIYSQRLLTLTGVYGFWKHVSNLDRLESRRYLEMFYALKYRKLAESVPLAVE

SEQ ID NO: 25745 - protein, 806 aa, Citrullus lanatus
MAERVLNRVHSLRERLDETLIAQRNEILGLLSKIEAKGKGILQHHQLIAEFEAIPEENRKKLADGDFGEVLRATQESIVLPPWVALAVRPRPGVWEYIKVNVHALVVEELQVAEYLHLKEELVDGSSNGNFVLELDFEPFNASFPRPTLSKSIGNGVEFLNRHLLAKLFHGKESMQPLLDFLRVHCYKGKTMMLNDRIQTLNAFQHVLRKAEEYLATLAPETPYSEFANKFEEIGLERGWGNTAERVLEMIQLLLDLLEAPDPCTFEKFLGRIPMVFNVVILSPHGYFAQDNVLGYPDTGGQVVYILDQVRALEHEMLQRIKQQGLDITPRILIITRLLPDAVGTTCTQRLEKVFGTEHSHILRVPFRNEKGIVRKWISRFEVWPYLETYTEDVAQELTKELQGKPDLIIGNYSDGNIVASLLAHKLGVTQCTIAHALEKTKYPDSDIYWKRFDDKYHFSSQFTADLIAMNHTDFIITSTFQEIAGSKDTVGQYESHTAFTLPGLYRVVHGIDVFDPKFNIVSPGADMSIYFPYTETEKRLTSFHPEIEELLYSEVENEEHLCVLKDRSKPIIFTMARLDRVKNITGLVEWYGKNKRLRELVNLVVVAGDRRKESKDNEEKAEMEKMYILIKTYNLNGQFRWISAQMNRVRNGEVYRCIADTKGAFVQPAVYEAFGLTVVEAMTCGLPTFATCNGGPAEIIIDGKSGFHIDPYRGDRAAEILVDFFEKSKEDPSHWDKISQAGLQRIYEKYTWQIYSERLLTLTGVYGFWKHVSNLDRLESRRYLEMFYALKYRKLADSVPQAVDE

SEQ ID NO: 25746 - protein, 258 aa, Nicotiana tabacum
MDTSSGDKSFTIDLNTKPSLQTINRIPHEILDEELIRMKEENKKLTTILTTLCENYNSLQTHLIELLQKHNSEDHNSKLLSRKRKAEDDHSCANSEIIFEEASPKRPREIRTNVSTVCVKTTPSDQSAVVKDGYHWRKYGQKVTRDNPSPRAYYKCSFAPSCPVKKKVQRSVEDPSVLVATYEGEHNHPLPSQAQVTVPLINQNVTTNPTFLNKFMEDIDTTSLQQDLVAQMASSLTENPSFTAAVAAAISGNFFEYD

SEQ ID NO: 25747 - protein, 246 aa, Cucumis sativus
MGRGRVELKRIENKINRQVTFAKRRNGLLKKAYELSVLCDAEVALIIFSNRGKLYEFCSTSNMLKTLERYQKCSYGAVEVTKPAKELESSYREYLKLKSRFESLQRTQRNLLGEDLGPLNSKELEQLERQLVSSLKQVRSTKTQYMLDQLSDLQNKEQMLIETNRALQIKLEEISSRNNIRLTWDGGDQSMSYGPQNAQTQGFFQPLECNPTLQIGYTSAVSDQITSTTTPTHAQQVNGFLPGWML

SEQ ID NO: 25748 - protein, 344 aa, Porteresia coarctata
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKLEHNH

SEQ ID NO: 25749 - protein, 379 aa, Aubrieta deltoidea
MSTTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKDHEKPVQQVIAEMTDGGVDRSVECTGSVQAMIQAFECVHDGWGVAVLVGVPSKDDAFKSHPMNFLNERTLKGTFFGNYKPKTDIPGVVEKYMNKELDIEKFITHTVPFSEINKAFDYMLKGEGIRCIITMGA

SEQ ID NO: 25750 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 25751 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIIAMGA

SEQ ID NO: 25752 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRYCHSEESNMCDLLRINTDRGGMIHDGESRFSIDGKPIYHFVGTFTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 25753 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRYCHSEESNMCDLLRINTDRGGMIHDGESRFSIDGKPIYHFLGTSTFSEYTVVHSGQVAKINPEAPLDKVCIVSCGVSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 25754 - protein, 379 aa, Cardamine amara
MITTGQIIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRKNTDRVGMIHDGVSRFSINGKPIHHFLGTSTFSEYTMVHSGQVAKINPEAPLDKVCIVSCGLSTGLGATLNVAKPKKGQSVAVFGLGAVGLAACEGARMSGASRIIGVDLNPKRFEEAKKFGVTEFVNPREHDKPVQQVIAEMTNGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGESIRCIITMGA

SEQ ID NO: 25755 - protein, 379 aa, Arabis blepharophylla
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHTVPFSEINKAFDYMLKGEGNRCIIRMGA

SEQ ID NO: 25756 - protein, 379 aa, Arabis blepharophylla
MSTTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSVESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLSSKRFDEAKKFGVTEFVNPKDHDKPVQEVIAEMTDGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGEGIRCIITMGA

SEQ ID NO: 25757 - protein, 379 aa, Brassica oleracea
  unsure (1)..(379): unsure at all Xaa locations
MSTTGQIIRCKAAVCWEAGKPLVMEEVEVAPPQKHEVRIKILFTSLCHTDVYFWEAKGQTPLFPRIFGHEAGGIVESVGEGVTDLXPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQEVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 25758 - protein, 379 aa, Capsella rubella
  unsure (1)..(379): unsure at all Xaa locations
MITTGLFIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNPSRFDQAKKFGVTEFVNPKDHDKPVQQVIAEMTNGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGESIRCIIXMGA

SEQ ID NO: 25759 - protein, 379 aa, Arabis drummondii
MSTTGQIIRCKAAVAWEAGKPLVMAEVEVAPPQKHEVRIKILFTSLCHTDIYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLGATLNVAKPKKGQSVAIFGLGAVGLAAAEGARIAGAFRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSGINKAFDYMLKGESIRCIIPMGA

SEQ ID NO: 25760 - protein, 379 aa, Arabis drummondii
  unsure (1)..(379): unsure at all Xaa locations
MITTGQIIRCKAAVAWEAGKPLVMEEVEVAPPQKHEVRIKILFTSLCHTDVYFWEAKGQTPLFPRIFGHEAGGIVESAGEGVTDLQPGDHVLPVFTGECGDCRHCHSEESNMCDLLRINTERGVTIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECAHDGWGVAVLVGVPSKDDAFKSHPMNFLNERTLKGTFFGNYKPKTDIPGIVEMYMNKELELEKFITHTVPFSEINKAFDNMXKGESIRCIITMGA

SEQ ID NO: 25761 - protein, 379 aa, Arabis fendleri
MITTGQIIRCKAAVAWEAGKPLVMEEVEVAPPQKHEVRIKILFTSLCHTDVYFWEAKGQTPRFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 25762 - protein, 379 aa, Arabis glabra
  unsure (1)..(379): unsure at all Xaa locations
MITTGXIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVGKPKRGQSVAIFGLGAVGLAAAEGARIAGASRIIGVDLNSKRFDQAKEFGVTEFVNPKDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMMKGESIRCIITMGA

SEQ ID NO: 25763 - protein, 379 aa, Olimarabidopsis pumila
MITTGQIIRCKAAVAWEAGKPLVMEEVEVAPPQKHEVRIKILFTSLCHTDVYFWEVKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLEATLNVAKGKKGQSVEIFGLGAVGLAAAEGARIAGASRIIGVDLNSKRFDQAKEFGVTEFVNPRDHDKPVQQGIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDHMLKEESIRCIITMGA

SEQ ID NO: 25764 - protein, 379 aa, Halimolobos perplexa var. lemhiensis
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGGMIHDGESRFSINGKPIHHFVGTSTFSEYTVVHSGQVAKINPDAPLDKVCIVSCGLSTGLGATLNVAKPKKGQSVAVFGLGAVGLAAAEGARIAGASRIIGIDLNPKRFDEAKKFGVTEFVNPKDHDKPVQQVIAEMTDGGVDRSLECTGNVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 25765 - protein, 379 aa, Arabidopsis halleri
MITTGQSIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 25766 - protein, 379 aa, Arabis hirsuta
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPVFTGECGDCPHCHSEESNMCDLLRINTERGGMIHDGESRFSIDGKPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTNGGVDRSVECTGSVQAMIQALECVHDGWGVAVLVGVPSKDDAFKTHPMNLLNERTLKGTFFGNYKPKTDIPGVVEKYMNKELELEKFITHTVPFSEINKAFDYILKGESIRCIITMGA

SEQ ID NO: 25767 - protein, 379 aa, Arabis hirsuta
  unsure (1)..(379): unsure at all Xaa locations
MITTGQIIRCKAAVAFEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGKPIYHFVGTSTFSEYTVVHSGQVAKINPDAPLDKVCIVSCGLSTGXGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAYKTHPMNFLNERTLKGTFFGNYKPKTDIPGLVEKYMNKELEIEKFITHTVPFSEINRAFDYMLKGEGIXCKITMGA

SEQ ID NO: 25768 - protein, 379 aa, Arabis hirsuta
  unsure (1)..(379): unsure at all Xaa locations
MSTTGQIIRCKAAVAWEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGNPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTXKGTFFGNYKPKTDIPGLVEKYMNKELEIEKFITHTVPFSEINKAFDYMLKGEGIRCIITMGA

SEQ ID NO: 25769 - protein, 379 aa, Arabis jacquinii
MITTGQIFRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCPHCHSEESNMCDLLRINTERGGMIHDGESRFSINGKPIHHFVGTSTFFEYTVVHSGQVAKIIPDAPLDKVCIVSCGLSTGLEATLNVAKPKKGQSVAIFGLGAVGLAAAEGARIAGASRIIGVDLNSKRFDEAKKFGVTEFVDPKDHDKPVQQVIAEMTDGGVDRSVECTGSVQAMIQAFECVHDGWGVAVLVGVPSKGDAFKTHPMNFLNERTLKGTFFGNYKPKTDIPGVVEKYMNKELELEKFITHTVPLSEINKAFDYMMKGESIRCIITMGA

SEQ ID NO: 25770 - protein, 379 aa, Arabis lignifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLRATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGSYKPKTDIPGIVEMYMNKELELEKFITHTVPFSEINKAFDYMLKGESIRCIITMGA

SEQ ID NO: 25771 - protein, 379 aa, Arabis lyallii
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 25772 - protein, 379 aa, Arabidopsis lyrata subsp. lyrata
  unsure (1)..(379): unsure at all Xaa locations
MITTGQIIRCKAAVAWVAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGGTLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCXIPMGA

SEQ ID NO: 25773 - protein, 379 aa, Arabis parishii
MSTTGQIVRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 25774 - protein, 379 aa, Arabis pauciflora
MITTGQIIRCKAAVAWEAGKPLVMEEVEVAPPQKHEVRIKILFTSLCHTDVYFWEAKGQTPLFPRIFSHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAILGLGAVGLAAAEGARIAGAARIIGVDLNPKRFEEAKKFGVTEFVNPREHDKPVQEVIAEMTDGGVDRSLECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 25775 - protein, 379 aa, Arabidopsis lyrata subsp. petraea
MITTGQIIRCKAAVAWEAGKPLVMEEVEVAPPQKHKVRIKILFTSLCHTDVYFWEAKGQTPLFPRIFGHEAGGIVESVGEGLTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCIITMGA

SEQ ID NO: 25776 - protein, 379 aa, Arabidopsis lyrata subsp. petraea
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVIEKYMNKELELEKFITHTLPFSEINKAFDYMLKGESIRCIITLGA

SEQ ID NO: 25777 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDWPHCHSEESNMCDLLRINTERGGMIHDGESRFSINGKPIHHFVGTSTFSEYTVIHSGQVAKINPDAPLDKVCIVSCGLSTGLEAPLNVANPKKGQSVAIFGLGAVGLAAVEGARIAGASRIIGVDLNSKRFDEAKKFGVTEFVNPKDHDKLVQQVIAEMTNGGVDRSVECTGSVQAMIQAFECVHDGWGVAVLVGVPSKDDAFKTHPMNFLNERTLKGTFFGNYKPKTDIPGLVEKYMNKELEIEKFITHTVPFSEINKAFDYMMKGEGIRCIITMGA

SEQ ID NO: 25778 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGVVESVGESVTDLAPGDHVLPIFTGECGDCPHCHSEESNMCDLLRINTERGVMIHDGESRFSIDGKPIYHFVGTSTFSEYTVIHSGQVAKINPDAPLDKVCIVSCGLSTGLGATLNVAKPKKGQSVAIFGLGAAGLAAAEGARIAGASRIIGVDLNSKRFDEAKKFGVTEFVNPRDHDKPVQQVIAEMTDGGVDRSVECTGSVQAMIQAFECVHDGWGVAVLVGVPSKDDAFKTDPMNFLNERTLKGTFFGNYKPKTDIPGLVEKYMNKELEIEKFITHTVPFSEINKAFDYMLKGKGIRCIITMGA

SEQ ID NO: 25779 - protein, 379 aa, Arabis turrita
MITTGQIIRCKAAVAWEAGKPLVMEVVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGVMIHGGESRFSINGKPIYHFLGTSTFSEYTVVHSGQVAKINPEAPLDKVCIVSCGLSTGLGATLNVAKPKKGHSVAIFGLGAVGLAAAEGARISGASRIIGVDLNPKRFEEAKKFGVTEFVNPRDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELEIEKFITHTVPFSEINKAFDYMLKGEGIRCIITMGA

SEQ ID NO: 25780 - protein, 379 aa, Barbarea vulgaris
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLTVAKPKKGQSVAVFGLGAVGLGAAEGAKMAGASRIIGVDLNPKRFEEAKKFGVTEFVNPREHDKPVQQVIADMTNGGVDRSVECTGSVQAMIQAFECVHDGWGVAVLVGVPSKDDAFKTHPMNFLNERTLKGTFFGNYKPKTDIPGVVEMYMNKELELEKFITHTVPFSEINKAFDYMLKGESIRCIITMGA

SEQ ID NO: 25781 - protein, 442 aa, Homo sapiens [sequence omitted]

SEQ ID NO: 25782 - protein, 123 aa, Asellus aquaticus
MTGRGKGGKVKGKSKSRSSRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKTEKK

SEQ ID NO: 25783 - protein, 331 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKSSIVLGSKGEVEKYLKHVPK

SEQ ID NO: 25784 - protein, 243 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTP

SEQ ID NO: 25785 - protein, 230 aa, Lycopersicon esculentum
ENVYMAKLADRAESDEEMVEFMEKVSNSLGSEELTVEERNLLSVAYKNVIGARRASWRIISSIEQKEESRGNEEHVNSIREYRSKIENELSKICDGILKLLDSKLIPSATSGDSKVFYLKMKGDYHRYLAEFKTGAERKEAAESTLTAYKAAQDIASAELAPTHPIRLGLALNFSVFYYEILNSPDRACNLAKQAFDEAIAELDTLGEESYKDSTLIMQLLRDNLTLWTS

SEQ ID NO: 25786 - protein, 419 aa, Legionella pneumophila
MHTNLKIIGCGGHCKVVIDALSLTQHSLQVSLCDSNKSFLGQEVCGVLVDSTMDSLADYIGYVHVSIGNNQARKNVIDLMNSNANLFTIIHPAAIIAKSARLGAGSFIAAQAILGPECQVGEGCIINHSAVVDHEVIVGSCSHIAPNSTLGGRVKIGERVLIGAGAVVLPGVTIGDGAIIGAGSVVVKDVKENAVVKGVPAQFKRNKMITIKELYIQKQENLKTALSKLDATAQGVLFLVDSDEHLIRTVTDGDIRRLLLKGFTLDSTLEELSEHSSKALPVSATIQDAYHLMQEYELDHIPVIDESNRPIRLIHRRELSSNILLSSPHIGEHEQQYVQEAFATNWVAPLGPNVDSFEKEVAEYINIKSAVALSSGTAAIHLALVLLDVKPGDIVFASSFTFVSHSESYLIPRCDSGIY

SEQ ID NO: 25787 - protein, 339 aa, Mus musculus
MTDRSPFETDMLTLTRYVMEKGRQAKGTGELTQLLNSMLTAIKAISSAVRKAGLANLYGISGSVNVTGDEVKKLDVLSNSLVINMLQSSYSTCVLVSEENKEAVITAQERRGKYVVCFDPLDGSSNIDCLASIGTIFAIYRKTTEDEPSEKDALQPGRNIVAAGYALYGSATLVALSTGQGVDLFMLDPALGEFVLVEKDVRIKKKGKIFSLNEGYAKYFDAATAEYVQKKKFPEDGSEPYGARYVGSMVADVHRTLVYGGIFMYPANQKSPNGKLRLLYECNPVAYIIEQAGGMATTGTQPVLDVKPESIHQRVPLILGSPEDVQEYLSCVQRNQAGR

SEQ ID NO: 25788 - protein, 56 aa, Mus musculus
LRLLYECNPIAYVMEKAGGLATTGDKDILDIVPTEIHQKAPVVMGSSEDVQEFLEI

SEQ ID NO: 25789 - protein, 63 aa, Mus musculus
LRLLYECNPIAYVMEKAGGLATTGDKDILDIVPTEIHQKAPVVMGSSEDVQEFLEIYRKHKAK

SEQ ID NO: 25790 - protein, 921 aa, Oryza sativa (indica cultivar-group)
MASKGTGGGHGGVERKEQQQQRGYQLPRDSRGSLEVFNPSSASSFRTAAAAAKSASPFLAIPDREEDNVVAQQRAAEWGLVLQTDYHTGLPQGVSTRPSSCSARTSSEDTPQQQQSAAAIPRVSEELRAALSAFQQTFVVSDATRPNHPIMYASAGFFNMTGYTSKEVVGRNCRFLQGSGTDPHEIDKIRQALANGSNYCGRILNYKKDGTPFWNLLTIAPIKDEDGRLLKFIGMQVEVSKYTEGKKETVVRPNGLSESLIKYDARQKDHARSSVSELLLALKNPRSLSESSNNTLKRKSQESLSMSMSEVPSKRSSESGSRRNSRSGTRSSLQKINEVPDQVNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRAIVRKIRDAIDNQAEVTVQLINYTKSGKKFWNLFHLQPMRDQKGDVQYFIGVQLDGTEHVQDDAAEEGVVLVKKTADNIDEAAKELPDANLRPEDLWANHSKVVLPNPHMKDTASWRAIQKVLESGESIGLKHFRPIKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYVAEVVIALEYLHCQGIIYRDLKPENILLHRDGHISLTDFDLSCLTSCRPQVFLPEDADEKKGRKNRSYPIFFAEPMRASNSFVGTEEYIAPEIITGAGHTSAVDWWALGILLYEMLYGYTPFRGKTRQRTFANILHKDIRFPASILVSLAARQLMYRLLHRDPANRLGSYEGANEIKGHPFFRGINWPLIRATAPPKLEIPLFSKDDMEKKGLVTDNRTDIF

SEQ ID NO: 25791 - protein, 513 aa, Populus balsamifera subsp. trichocarpa
MDSLLQSLQTLPMSFFLIIISSIFFLGLISRLRRRSPYPPGPKGFPLIGSMHLMDQLTDRGLAKLAKQYGGLFHMRMGYLHMVAGSSPEVARQVLQVQDNMFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 25792 - protein, 452 aa, Streptococcus pyogenes
NLMTRDIIGNLSTFELAILILLVFVAFYFIHLAVRDYRNARIIRMMSHKIRDLINGRYTDIIDEKADIELMELSDQLNDLSDVFRLTHENLAQEKNRLASILAYMSDGVLATDRSGKIIMINETARKQLNLSKEEALKKNITDLLEGDTSYTYRDLVSKTPVVTVNSRNDMGEFVSLRLRFALNRRESGFISGLVVVLHDTTEQEKEERERRLFVSNVSHELRTPLTSVKSYLEALDEGALKEDIAPSFIKVSLDETNRMMRMISDLLNLSRIDNQVTQLAVEMTNFTAFITSILNRFDLVKNQHTGTGKVYEIVRDYPITSVWIEIDNDKMTQVIENILNNAIKYSPDGGKITVRMKTTDTQLIISISDQGLGIPKTDLPLIFDRFYRVDKARSRAQGGTGLGLAIAKEIIKQHHGFIWAKSDYGKGSTFTIVLPYEKDAAIYEEWEEDVD

SEQ ID NO: 25793 - protein, 435 aa, Thermus thermophilus
MIHDPAQLEKERPDRLRVLWLSTLAFTLMFAAWLMFGVLGVPIRKEFGLSDVQLSWISALAILNGSLWRLLAGILADRYGGRLVFTLMLFFTAIPAYLVSRAGSYEELLLYAFLVGFAGNSFSVGIAWNSAWFPKDQQGFALGVFGAGNVGASVTKFIGPALIASVPASGYLGGLIPGGWRFIPFLYAVLLVLMGFVLWFGTPRKDKRPGQGRPFLDMLKPLRYVRVWRFSLYYVVVFGAYVALSAWLPKYYVDVFGLPLHEAALLTALFIFPASLLRPVGGYLSDRFGARRIMYWTFGIILLASGVLMMPEGHIVLYTKQGAKEVMQFTMGVELFTLLVFLIGVGMGIGKAAVYKHIPTYFPQDVGAVGGLVGMLGALGGFFLPPLFAYAQAWTGLPQMTFFVLFLLAAISFLWMHLTVLKLLQQEAQHLKKRL

SEQ ID NO: 25794 - protein, 411 aa, Welwitschia mirabilis
MAPESFSAAFFKWEQRSSIPLQMQRPGNIFQDFGMPNSSNIGAPPMLTSNTTACINTRKEMVCLEELFRNYGVRYITMTKMMEMGFTVSTLLNMTEQELDEVIRTLVEIYRMELLVGEKYGIKSAVRAEKRRLEEAEKKRLQELFNDVDGKRKIDENALDTLSQEGLSVEEPHGDNTILLSQNNTASSFPLNLNAGTDPVLLLQNGGRMGSTVSGFAGFPENNFEDLHGKTCKKQKRRRLKESGEEGEDRQREHPFIVTEPGELARGKKNGLDYLFDLYEQCGKFLLEVQQIAKERGEKCPTKVTNQVFRHAKYSGASYINKPKMRHYVHCYALHCLDEEQSNRLRKAYKERGENVGAWRQACYYPLVAKARENGWDIDGVFNKHEKLRIWYVPTKLRQLCHHEKSKQSHL

SEQ ID NO: 25795 - protein, 365 aa, Oryza sativa
MCGGAIIHHLKGHPEGSRRATEGLLWPEKKKPRWGGGGRRHFGGFVEEDDEDFEADFEEFEVDSGDSDLELGEEDDDDVVEIKPAAFKRALSRDNLSTITTAGFDGPAAKSAQRKRKNQFRGIRHRPWGKWAAEIRDPRKGVRVWLGTFNSAEEAARAYDAEARTIRGKKPKVNFPEAPTTAQKRRAGSTTAKAPKSSVEQKPTVKPAFNNCANAMAFVYPSANFTSNKPFVQPDNMPFVPAMNSAAPIEDPIINSEQGSNSFGCSDFGWENDTKTPDITSIAPISTIAEVDESAFIKSSTNPMVPPVMENSGVDLPDLEPNMRFLLDDGGGDSIDSLFNLDGSQDVVSNMDLWSFDDMPVSDFY

SEQ ID NO: 25796 - protein, 371 aa, Nicotiana tabacum
MPSRISDSFRAHSQKHLDLNSIKELPESHAWTSSNDYPSENSCNFESIPVIDLDNYINNNNINVLEHIGQACKKWGAFQIINHNISERLLQDIELAGKSLFSLPMQQKLKAARSPEGVTGYGVARISSFFSKLMWSEGFTIVGSPLEHARQIWPHDYQKFCDVIEEYEREMEKLAGRLMWLMLGSLGITKEEVKWAVCPKGESKGGSAALQLNSYPACPDPDRAMGLAAHTDSTILTILHQNNTSGLQVFKEGSGWVTVPPFPGALVVNVGDLLHILSNGLYPSVLHRAVVNRTRHRLSVAYLYGPPSRVKVSPLAKLVDQRHPPLYRAVTWSEYLGTKARHFDKALSSVRLCAPLSGFTDAKDHNGVQVG

SEQ ID NO: 25797 - protein, 506 aa, Corynebacterium ammoniagenes
MTENRVSTGGDDPNKVALHGLTFDDVLLLPAESNVVPSEVDTSAQFTRNTRLGIPLASAAMDTVTEARMAIAMARQGGIGVLHRNLSSQEQAEQVEIVKRSESGMVTDPVTANPDMTIQEVDDLCARFRISGLPVVNEDGTLLGICTNRDMRFERDYSRKVSDIMTAMPLVVAKEGVSKEEALDLLSTNKVEKLPIVDKNNKLVGLITVKDFVKTEQFPNSSKDASGRLLVAAGIGTGEESYERAGLLVDAGVDVLIVDSAHAHNNRVLEMVSRVKNDFGSKIDVVGGNLATRSAAKAMIEAGADAIKVGIGPGSICTTRVVAGVGAPQITAIMEAATVASAAGVPLIADGGMQYSGDVAKALAAGADSVMLGSMFAGTLEAPGDIVIVGGKQYKRYRGMGSMGAMQGRGLSGEKRSYSKDRYFQADVRSEDKLVPEGVEGKVPYRGEIGQITHQIVGGLRAAMGYTGSATIEELKTKQFVRITTAGLAESHPHHLQQTVEAPNYR

SEQ ID NO: 25798 - protein, 1128 aa, Mus musculus
MAECGRGAAGGALPTSPSPALGAKGALKAGAGEGGGGGGGGRLGHGRARYDSGGVSNGDCSLGVSGDEARTSPGRGPLGVALARTPSPAAGPVPRDSKPGGLPRRSSIIKDGTKQKRERKKTVSFSSMPTEKKISSASDCIHSMVEGSELKKVRSNSRIYHRYFLLDADMQSLRWEPSKKDSEKAKIDIKSIKEVRTGKNTDIFRSNGISEQISEDCAFSVIYGENYESLDLVANSADVANIWVTGLRYLISYGKHTLDMLESSQDNMRTSWISQMFSEIDVDGLGHITLCHAVQCIRNLNPGLKTSKIELKFKELHKSKDKAGTEITKEEFIEVFHELRTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVVYTGHTMTSQIVFRSVIDIINKYAFFASEYPLILCLENHCSIKQQKVMVQHMKKILGDKLYTTSPNMEESYLPSPDVLKGKILIKAKKLSSNCSGVEGDVTDEDEGAEMSQRMGKENVEQPNHVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNVGWFRQNGNCGYVLRPAIMREEVSFFSANTKDSVPGVSPQLLHIKIISGQNFPKPKGSGAKGDVVDPYVYVEIHGIPADCAADRTKTVNQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNNPLVVLNLSEPYPTMELQAIVPEVLKKIVTTYDMMMQSLKALIENADAVYEKIVHCQKAAMEFHEHLHSIGTKEGLKERKLQKAVESFTWNITILKGQADLLKYAKNETLENLKQIHFAAVSCGLNKPGTENSEAQKPRRSLEAIPEKASDENGD

SEQ ID NO: 25799 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADIGYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVREKQWSPDDADAADEPPSSGKIPVFGELLGALKDLPRPMLLLLIVTCLNWIAWFPFILFDTDWMGREIYGGTAGKGKLYDQGVRAGSLGLLLNSVVLGLTSIAVEYLVRGVGGVKILWGVVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 25800 - protein, 509 aa, Bacillus cereus
MWESKFVKEGLTFDDVLLVPAKSDVLPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLDEAEKILQKYKIEKLPLVDNNGVLQGLITIKDIEKVIEFPNSAKDKQGRLLVGAAVGVTADAMTRIDALVKASVDAIVLDTAHGHSQGVIDKVKEVRAKYPSLNIIAGNVATAEATGALIEAGANVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFVRMSGAGLLESHPHHVQITKEAPTTHYNVLYINRRRFYISVYFFLIMLE

SEQ ID NO: 25801 - protein, 302 aa, Leishmania major
MDFAFRLFTSVIPVDREKMTHQMLVFWLILTSGGVSMYLLFASISYFTYFRKLKRQFFPKTIDPDDARELHEQVRQEIWIAVCSIPFMAFLMMPAVTFSHRGYSKLYYNISDYGWAYFLMSPVLFFAFTDFMVYCFHRGLHHPIIYKHVHKLHHTYKYTTPFSSHAFNPVDGFGQGVPYYVFVYLFPLHNILFLVLFLAVNFWTISIHDQVDFGGHFINTTGHHTIHHELSNCDYGQYTTVWDRLGGSYRPAEQTHQLSSLLHAGDPKYVDPVYESYHEKKGFLAGRFKEEAAARRSKKVGA

SEQ ID NO: 25802 - protein, 251 aa, Arabidopsis lyrata
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLNAMSPKELQNLEQQLDTALKNIRTRKNQLMYESINELQRKEKAIQEQNSMLSKQIKEREKILRAQQEQWDQQNHGHNMPPPPPPQQHQIQHPYMLSHQPSPFLNMGGLYQEEDPMAMRRNELELTLEPVYNCNL

SEQ ID NO: 25803 - protein, 231 aa, Arabidopsis lyrata
  unsure (1)..(231): unsure at all Xaa locations
MARGKIQIKRIENQTNRQVTYSMRRNGLFKKAHELTVLCDARVSIIMFSSSNKLHEYISPNTTTKEIVDLYQTVSDVDVWATQYERMQETKRKLLETNRNLRTQIKQRLGECLDELDIQELRRLEDEMENTFKLVRERKIKSLGNQIETTKKKNKSQQDIQKXLIHELELRAEDPHYGLVDNGGDYDSVLGYQIEGSRAYAFRFHQNHHHQYPNHALHAPSASDIITFHLL

SEQ ID NO: 25804 - protein, 208 aa, Arabidopsis lyrata
MGRGKIEIKRIENANNRVVTFSKRRNGLVKKAKEITVLCDAKVALIIFASNGKMVDYCCPSMDLGAMLDQYQKLSGKKLWDAKHENLSNEIDRIKKENDSLQLELRHLKGEDIQSLNLKNLMAVEHAIEHGLDKVRDHQMELLNSKRRNDKMIMEEHRQLTFQLQQQDMAIASNARGMMMRDHDGQFGYRVQPIQPNLQEKIMSLVID

SEQ ID NO: 25805 - protein, 357 aa, Arabidopsis thaliana
MYVMHVAAVVWGPKVPLVIQEICVDPPQKMEVRVKILYSSICHTDLGCWNGTSVGEGVKDVKEGDYVIPTFNGECGECKVCKREESNLCERYHVDPMKRVMVNDGGTRFSTTINKDGGSSQSQPIYHFLNTSTFTEYTVLDSACVVKIDPNSPLKQMSLLSCGVSTGVGAAWNIANVKEGKSTAVFGLGSVGLAVAEGARARGASRIIGVDANASKFEKGTVPIYDYVHIITILLQSNIAGKLMGVTDFINPKDLTKPVHQGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 25806 - protein, 524 aa, Bacillus subtilis
MEHLDLHHIFELGFFVVMIAAGITAIAKKCRQPYPIALVIVGTIIGLVHIPLFEPLKEFITEGEVFNFVIITLFLPALLGEAALKLPFSHLRENKRPVLALFGGTLISFLIVGFSSMWLMHLAIPAAFVFAALMSATDPVSVLSIFKSVGAPKKLSIVVEGESLFNDGLAVVLFNISAFYLMTYLDLGIQGAGLGLWEFVKVISLGLIIGGVLGYVFSQLTKYFDDYPLEIIFSIILFYSSFLLAEMAGASGVIAVVVAALIFGNYGAKIGMSPTTKLNINNFWDVAALLANSLVFLMVGLEITRIDLTDKWGLAIMAIVIVLIARSAAVYISLAFIKKFPVTWKHTINWGGLKGSLSIALVLSLPRDFPGREDILVFAFSVVLFSLVVQGLTIKPLLERLGVNQKEEGNQEYEELLAKGHRLETAIKEVQQVKHNLLIHEAVSSELTDQYKKEVSQLHQQTNKLFETYPELKNKQQTILKKHSLYAQYQAIENLSREDIISNEVAELEQARIIDEIVRLQNDH

SEQ ID NO: 25807 - protein, 513 aa, Aspergillus parasiticus
MVAGGGIVSSSGMDAYRALPNNTNSNWFKDKGLRRLNFGLMLMFASAAANGYDGALMNGLLTLPMCEFPLSSCPHLWRMFTFIPASYFADYFGRKMSVALGSAIMIVASVIQAATVGRWAFFGTRIAMGIGLGFAQTAAPPLTTEIAHPRHRGVVTAIFQATWYWGAILAAAVCLATLYVEGSTWSWRIPCLVQCFFPAVQLLGLLIVPESPRWLVSKDRRDEALQILARYHGNCDTSDPLVQFEFSEICSAIELENSVAHKSGWSAFIATKGARHRLAICLLVGVMIQWAGNGVISYYLAPILRSVGITNPTQQSAINLGLQAWNAVCAAGGAVAAEKYGRRPLWMLSTVLMLLFFTLATVLSAVFDESAIKAAGSAVVAFLYLFYGAYDIAYTPLSIAYPVEIMPFYLRTKGLSLSLTAQFGAGFFNQFVNPIALGAIKWKFYFVYLGLLVIFLGIVYFVFPETKGHTLEEIAVIFDGPGAETEVQRDLAAIIAVEREVKAPMKEELEHAP

SEQ ID NO: 25808 - protein, 167 aa, Fragaria x ananassa
GTMGGACGYGNLYSQGYGVNTAALSTALFNNGLSCGACFEIKCGDDPRWCTAGKPSIFVTATNFCPPNFAQPSDNGGWCNPPRTHLDLRHAHVLKIAEYKAGIVPVSYRRVPCVKKGGIRFTINGHKYFNLVLITNVAGAGDIVSVSVKGTNTGWMPMSRNWGQNWQ

SEQ ID NO: 25809 - protein, 542 aa, Homo sapiens
MPLRDETLREVWASDSGHEEESLSPEAPRRPKQRPAPAQRLRKKRTEAPESPCPTGSKPRKPGAGRRGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKNSNQKGKAKGKGKKKAKEERAPSPPVEVDEPREFVLRPAPQGRTVRCRLTRDKKGMDRGMYPSYFLHLDTEKKVFLLAGRKRKRSKTANYLISIDPTNLSRGGENFIGKLRSNLLGNRFTVFDNGQNPQRGYSTNVASLRQELAAVIYETNVLGFRGPRRMTVIIPGMSAENERVPIRPRNASDGLLVRWQNKTLESLIELHNKPPVWNDDSGSYTLNFQGRVTQASVKNFQIVHADDPDYIVLQFGRVAEDAFTLDYRYPLCALQAFAIALSSFDGKLACE

SEQ ID NO: 25810 - protein, 656 aa, Arabidopsis thaliana
MDTNTSGEELLAKARKPYTITKQRERWTEDEHERFLEALRLYGRAWQRIEEHIGTKTAVQIRSHAQKFFTKFGKAHSFWFTFQLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 25811 - protein, 840 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQERSVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGEILLP

SEQ ID NO: 25812 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEGEAPK

SEQ ID NO: 25813 - protein, 433 aa, Mus musculus
MLELIEVNGTPGSQLSTPRSGKSPSPSPTSPGSLRKQRISQHGGSSTSLSSTKVCSSMDENDGPGEEESEEGFQIPATITERYKVGRTIGDGNFAVVKECIERSTAREYALKIIKKSKCRGKEHMIQNEVSILRRVKHPNIVLLIEEMDVPTELYLVMELVKGGDLFDAITSTSKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELINMMLLVNVDQRFSAVQVLEHPWVNDDGLPENEHQLSVAGKIKKHFNTGPKPSSTAAGVSVIATTALDKERQVFRRRRNQDVRSRYKAQPAPPELNSESEDYSPSSSETVRSPNSPF

SEQ ID NO: 25814 - protein, 110 aa, Betula pendula
AFEDGDLKLFESRAITKYIAHQYADKGAELVCGDTKQKAMIGVAIEVEAHQFDPPASKLCWELALKPMFGMVTDKAVVEEHEAKLAIVLDIYEKRLAQSKYLTCDCFTLA

SEQ ID NO: 25815 - protein, 185 aa, Betula pendula
KECRHCKSEESNLCELLRINTDRGVMLSDGKSRFSIKGKPIFHFVGTSTFSEYTVVHRGCAVKINPLAPLDKVCILSCGISTGLGATLNVAKPKKGSSVAVFGLGAVGLAAAEGARIAGASRIIGVDLHPDRIKEARKFGVTELVNPKDHKKPIQEVIADMTDGGVDRSVECTGNVDCMISAFEC

SEQ ID NO: 25816 - protein, 287 aa, Lycopersicon esculentum
MKRFSFSDSSGKLLYPTEEKKENLGYSNEFQAMLDGLEDEDGIEESGCGTGKKRRLRVDQVQALEKIFEVDNKLDPDRKVKIAQELGLQPRQIAIWFQNRRARWKTKQLERDYNILKSNYEALQHNYTKVEQEKEGLITELKGLKEKLGEETLLSPVFQRPQEILNKLKNSSDFVDSKDGSSDSDSSGVMNEETYNISTLNYQQLMPKVSSYSNSLDHLSLSSSTYTQLMDPRASNSTSSSMRAYNNNNNNNDDNNNSNNQQQQQAVGRIEEAKWFYNRGFLQHLLC

SEQ ID NO: 25817 - protein, 375 aa, Mus musculus
MSTAGKVIKCKAAVLWELHKPFTIEDIEVAPPKAHEVRIKMVATGVCRSDDHVVSGTLVTPLPAVLGHEGAGIVESVGEGVTCVKPGDKVIPLFSPQCGECRICKHPESNFCSRSDLLMPRGTLREGTSRFSCKGKQIHNFISTSTFSQYTVVDDIAVAKIDGASPLDKVCLIGCGFSTGYGSAVKVAKVTPGSTCAVFGLGGVGLSVIIGCKAAGAARIIAVDINKDKFAKAKELGATECINPQDYSKPIQEVLQEMTDGGVDFSFEVIGRLDTMTSALLSCHAACGVSVVVGVPPNAQNLSMNPMLLLLGRTWKGAIFGGFKSKDSVPKLVADFMAKKFPLDPLITHVLPFEKINEAFDLLRSGKSIRTVLTF

SEQ ID NO: 25818 - protein, 358 aa, Spinacia oleracea
AAVGEAATQTKARTRSKYEIETLTGWLLKQPMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWPDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 25819 - protein, 377 aa, Arabidopsis thaliana
MWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 25820 - protein, 388 aa, Arabidopsis thaliana
MYFHYYGQLLHQQNMLQDYVRTGTYYAAVMENHSDFAGRVVVDVGAGSGILSMFAAQAGAKHVYAVEASEMAEYARKLIAGNPLFADRITVIKGKVEDIELPEKADILISEPMGTLLVNERMLESYVIARDRFMTPKGKMFPTVGRIHMAPFSDEFLFIEMANKAMFWQQQNYYGVDLTPLYGSAHQGYFSQPVVDAFDPRLLVASPMFHMIDFTQMKEEDFYEIDIPLKFTASMCTRMHGLACWFDVLFDGSTVQRWLTTAPGAPTTHWYQIRCVLSQPIYVMAGQEITGRLHLIAHSAQSYTIDLTLSAKMWGPGASQGGILQSSTCKFDLKEPYYRMSQPQAYPVAQEPPLQPQPELSTQDIQTPNDELEEELLQQLPQNPSAQL

SEQ ID NO: 25821 - protein, 306 aa, Oryzias latipes
MALRVTRNRLASTRAELGGKTCSVAGPTQKPRAALGEIGNVAVINKDVTKKTIKTEVAKKTKIPAKAEKIELPKAAVVPVKPAPEVQVTEVPDQAEPASPTPMETSGCESADLCQAFSDVILNTAIRDVDADDYDNPMLCSEYVKDIYKYLRQLEMEHSVKPNYLEGQEITGNMRAILIDWLVQVGLKFRLLQETMYMTVGIIDRFLQDHPVPKKQLQLVGVTAMFLASKYEEMYPPEISDFAYVTDRAYTTAQIRDMEMTILRVLKFQLGRPLPLQFLRRASKIYEVWRGVGAANCSLPPLHVLR

SEQ ID NO: 25822 - protein, 359 aa, Oryzias latipes
MSSVEIVAQQLLAAEHPRRMGKGAAADPRRAALGELTNLNAAAATNGTGAAASAPVLAKPSVKEEQELCQAFSEVLLAVQDVDEQDADQPQLCSQYVKDIYKYLHILEEQQPVRANYMQGYEVTERMRALLVDWLVQVHSRFQLLQETLYLTVAILDRFLQVHPVSRRKLQLVGVTAMLVACKYEEMYAPEVGDFAYITDNAFTKSQIVEMEQVILRSLSFQLGRPLPLHFLRRATKVAGADVEKHTLAKYLMELTLLDYHMVHYRPSEVAAAALCLSQLLLDGLPWSLTQQQYSTYEEQHLKPIMQHMAKNVVLVNEGRTKFLAVKKKYSSSKLMKISLIPQLNSSTVKTMADALHDP

SEQ ID NO: 25823 - protein, 1023 aa, Arabidopsis thaliana
PRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWPHVPEEMSAEAHDIIDRFLTEDPHQRLGARGAAEVKQHIFFKDINWDTLARQKAAFVPASESAIDTSYFRSRYSWNTSDEQFFPSGEVPDYSDADSMTNSSGCSSNHHEEGEAEECEGHAEFESGIPVDYSFSNFSFKNLSQLASINYDLLSKGWKDEPQQIPHHK

SEQ ID NO: 25824 - protein, 265 aa, Mus musculus
GSVDIEVQDLEEFALRPAPQGITIKCRITRDKKGMDRGMFPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVCIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 25825 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 25826 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDESLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 25827 - protein, 298 aa, Oryctolagus cuniculus
TRDAALPGSHSTHGFYENYEPKEILGRGVSSVVRRCIHKPTCKEYAVKIIDVTGGGSFSAEEVQELREATLKEVDILRKVSGHPNIIQLKDTYETNTFFFLVFDLMKKGELFDYLTEKVTLSEKETRKIMRALLEVICALHKLNIVHRDLKPENILLDDDMNIKLTDFGFSCQLDPGEKLRSVCGTPSYLAPEIIECSMNDNHPGYGKEVDMWSTGVIMYTLLAGSPPFWHRKQMLMLRMIMSGNYQFGSPEWDDYSDTVKDLVSRFLVVQPQKRYTAEEALAHPFFQQYVVEEVRHF

SEQ ID NO: 25828 - protein, 374 aa, Equus caballus
STAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVAVTPDSQNLSMNPMLLLSGRTWKGAIFGGFKSKDSVPKLVADFMAKKFALDPLITHVLPFEKINEGFDLLRSGESIRTILTF

SEQ ID NO: 25829 - protein, 299 aa, Homo sapiens
  unsure (1)..(299): unsure at all Xaa locations
SMENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYXHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 25830 - protein, 259 aa, Homo sapiens
EVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 25831 - protein, 489 aa, Oryza sativa; identical to SEQ ID NO: 3606

SEQ ID NO: 25832 - protein, 349 aa, Vicia faba
MDMPPPIMHDSDRYDFVRDIGSGNFGVARLMTDKLTKDLVAVKYIERGDKIDENVKREIINHRSLRHPNIVRFKEVILTPTHLAIVMEYASGGEMSDRISKAGRFTEDEARFFFQQLISGVSYCHSMQVCHRDLKLENTLLDGDPALHLKICDFGYSKSSVLHSQPKSTVGTPAYIAPEVLLKQEYDGKIADVWSCGVTLYVMLVGSYPFEDPDNPKDFRKTIQRVLSVQYSVPDFVQISPECRDIISRIFVFDPAERITIPEIMKNEWFRKNLPADLVNENIMDNQFEEPDQPMQSMDTIMQIISEATVPAAGSYYFDEFIEVDEDMDEIDSDYELDVDSSGEIVYAI

SEQ ID NO: 25833 - protein, 316 aa, Trichomonas vaginalis
MAQPAEQILIATSPKPSLSPVERLSVGFIAGTLSRTLTSPLDVVKMLMQVSSRGGSAKDTIAQLWKEQGIAGFWRGNWAACIRLGPQSAIKFYAYEELEKRIGKGKPLVGIQRTVFGSLSGVISQVLTYPLDVIRTRITVYSGKYTGIFNCAFTMLKEEGFTSLFAGIVPTVMGVIPYEGAQFYAYGGLKQLYTTKIAPGKPISPWANCLIGAAAGMFSQTFSYPFDVIRKRMMLKDEKGKPIYSGMMQAFSTVYAKEGVAGLYRGVGLNLIKVVPFAALQFTILEETRRAFFKVRAAIDQKKVEEIKGKVAPKKK

SEQ ID NO: 25834 - protein, 177 aa, Drosophila melanogaster
  unsure (1)..(177): unsure at all Xaa locations
DSLYAGCTEVTGEEFNVEPVDDGPGAFRCFLDVGLARTTTGARVFGAMKGAVDGGLNIPHSVXLFPGYSAETKSFNADVHRAHIFGQHVADYMRSLEEEDEESFKRQFSRYIKLGIRADDLEDIYKKAHQAIRNDPTHKVTAKNLLPLRXKXGMLRNSXTNNXRLRLQLIRHIFCQX

SEQ ID NO: 25835 - protein, 342 aa, Malus x domestica
MENSTQESHLRAENSVTYESPYPLYAMAFASPQTRTRHQHHRIAVGSFIEEYSNRVDILSFDPDTLSIKPNPTLSFDHPYPPTKLMFHPNPNALHKTNDVLASSGDYLRLWEVGDSTVEPIQVLNNSKTSEFCAPLTSFDWNDIEPRRIGTSSIDTTCTIWDIEKGVVETQLIAHDKEVYDIAWGEARVFASVSADGSVRIFDLRDKEHSTIIYESPQPDTPLLRLAWNKQDLRYMATILMDSNKVVILDIRSPTMPVAELERHRGSVNAIAWAPQSCRHICSAGDDTQALIWDLPTVAGPNGIDPMSMYSAGAEINQLQWSAAQPDWISIAFSNKMQLLKV

SEQ ID NO: 25836 - protein, 259 aa, Euphorbia esula
MDSSKDRETFVYLAKLAEQAERYDEMVESMKKVANLDVELTVEERNLLSVGYKNVVGSRRASWRILSSIEQKEESKGNEINAKRIKEYRNKVESELSTICSDIMTVIDEHLIPSCNAGESTVFYYKMKGDYYRYLAEFKAGNDKKEAADQSLKAYQTASTTAETDLPPTHPIRLGLALNFSVFYYEIMNSPERACHLAKQAFDEAISELDTLSEESYKDSTLIMQLLRDNLTLWTSDIPEDGDQKMETSGKASGGEDAE

SEQ ID NO: 25837 - protein, 377 aa, Mus musculus
MGTQGKVIKCKAAIAWKTGSPLCIEEIEVSPPKACEVRIQVIATCVCPTDINATDPKKKALFPVVLGHECAGIVESVGPGVTNFKPGDKVIPFFAPQCKRCKLCLSPLTNLCGKLRNFKYPTIDQELMEDRTSRFTCKGRSIYHFMGVSSFSQYTVVSEANLARVDDEANLERVCLIGCGFSSGYGAAINTAKVTPGSTCAVFGLGCVGLSAIIGCKIAGASRIIAIDINGEKFPKAKALGATDCLNPRELDKPVQDVITELTAGGVDYSLDCAGTAQTLKAAVDCTVLGWGSCTVVGAKVDEMTIPTVDVILGRSINGTFFGGWKSVDSVPNLVSDYKNKKFDLDLLVTHALPFESINDAIDLMKEGKSIRTILTF

SEQ ID NO: 25838 - protein, 316 aa, Mus musculus
MATFVELSTKAKMPLVGLGTWKSSPGQVKEAVKAAIDAGYRHIDCAYVYHNENEVGEAIQEKIKENAVKREDLFIVSKLWATFFEKSLVKKAFDNTLSDLKLDYLDLYLVHWPQGFQAGNALLPKDNKGKVLLSKSTFLDAWEAMEELVDQGLVKALGISNFNHFQIERLLNKPGLKHKPVTNQIESHPYLTQEKLIQYCQSKGIAVTAYSPLGSPDRPYAKPEDPVVMEIPKIKEIAAKHKKTVAQVLIRFHVQRNVVVIPKSVTPSRIQENLQVFDFQLSEEDMAAILSFNRNWRACDLLDARTEEDYPFHEEY

SEQ ID NO: 25839 - protein, 343 aa, Mus musculus
MLLLKKQTEDISSVYEIREKLGSGAFSEVMLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALQHLWISGDAAFDRDILGSVSEQIQKNFARTHWKRAFNATSFLRHIRKLGQSPEGEEASRQCMTRHSHPGLGTSQSPKW

SEQ ID NO: 25840 - protein, 469 aa, Mus musculus
MLKVTVPSCPSSPCSSVTASTENLVPDYWIDGSNRDPLGDFFEVESELGRGATSIVYRCKQKGTQKPYALKVLKKTVDKKIVRTEIGVLLRLSHPNIIKLKEIFETPTEISLVLELVTGGELFDRIVEKGYYSERDARDAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVKKLIVLDPKKRLTTFQALQHPWVTGKAANFVHMDTAQKKLQEFNARRKLKAAVKAVVASSRLGSASSSHTSIQENHKASSDPPSTQDAKDSTDLLGKKMQEEDQEEDQVEAEASADEMRKLQSEEVEKDAGVKEEETSSMVPQDPEDELETDDPEMKRDSEEKLKSVEEEMDPMTEEEAPDAGLGVPQQDAIQPEY

SEQ ID NO: 25841 - protein, 924 aa, Mus musculus
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKLNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKKGTAGLIPSPEIQGWRVACIAMEKTKQEQQASCTWFGKKKKQYKDKYLAKHNAVLIIDLVTYEEVVKLPAFKRKTSVLLGAHGVGRRHIKNTLITKHPDRFACPIPHTTRPPKKDEENGKNYYFVSHDQMMRDISNNEYLEYGSHEDAMFGTKLDHRKIHEQGLIAILDVEPQALKVLRTAEFPPFVVFIAAPTITPGLNEDESLQRLQKESDVLQRTYAHYFDLTIINNEIDETIRHLEEAVELVCTAPQWVPVSWVY

SEQ ID NO: 25842 - protein, 422 aa, Mus musculus
MPGTSRHSGRDAGSALLSLHQEDQENVNPEKLAPAQQPRAQAVLKAGNVRGPAPQQKLKTRRVAPLKDLPINDEHVTAGPSWKAVSKQPAFTIHVDEAEETQKRPAELKETECEDALAFNAAVSLPAARKPLTPLDYPMDGSFESPHAMDMSIVLEDKPVNVNEVPDYQEDIHTYLREMEVKCKPKVGYMKRQPDITNSMRAILVDWLVEVGEEYKLQNETLHLAVNYIDRFLSSMSVLRGKLQLVGTAAMLLASKFEEIYPPEVAEFVYITDDTYSKKQVLRMEHLVLKVLAFDLAAPTVNQFLTQYFLHLQPANCKVESLAMFLGELSLIDADPYLKYLPSLIAGAAFHLALYTVTGQSWPESLAQQTGYTLESLKPCLVDLHQTYLKAPQHAQQSIREKYKHSKYHSVSLLNPPETLSV

SEQ ID NO: 25843 - protein, 403 aa, Mus musculus
MSRRSRLQAKQHAQPNQPDSPQETQIIQAKKRKTAQDVKKRKEEITKKHQYEIRNCWPPVLSGGISPCIIIETPHKEIGTSDFSRFTNYRFKNLFINPSPLPDLSWACSQEVWQNMLQKENRYVHDKHFQVLHSDLEPQMRSILLDWLLEVCEVYTLHRETFYLAQDFFDRFMLTQKDVNKNMLQLIGITSLFIASKLEEIYAPKLQEFAYVTDGACSEVDILKMELNILKALKWELCPVTVISWLNLFLQVDAVKDVPKVLLPQYSQETFIQIAQLLDLCILAIDSLEFQYRILAAAALCHFTSIEVVKKASGLEWDDISECVDWMVPFVSVVKSVSPVKLKTFKKIPMEDRHNIQTHTNYLALLNEVNYVNIYRKGGQLSPVCNGGIMTPPKSTEKPPGKH

SEQ ID NO: 25844 - protein, 350 aa, Mus musculus
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRKEPFFHGQDNYDQLVRIAKVLGTDELYGYLKKYHIDLDPHFNDILGQHSRKRWENFIHSENRHLVSPEALDLLDKLLRYDHQQRLTAKEAMEHPYFYPVVKEQSQPCAENTVLSSGLTAAR

SEQ ID NO: 25845 - protein, 359 aa, Mus musculus
MTLESMMACCLSDEVKESKRINAEIEKQLRRDKRDARRELKLLLLGTGESGKSTFIKQMRIIHGAGYSEEDKRGFTKLVYQNIFTAMQAMVRAMETLKILYKYEQNKANALLIREVDVEKVTTFEHQYVNAIKTLWSDPGVQECYDRRREFQLSDSAKYYLTDVDRIATVGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILHSHLVDYFPEFDGPQRDAQAAREFILKMFVDLNPDSDKIIYSHFTCATDTENIRFVFAAVKDTILQLNLKEYNLV

SEQ ID NO: 25846 - protein, 379 aa, Mus musculus
MSGVVRTLSRCLLPAEAGARERRAGAARDAEREARRRSRDIDALLARERRAVRRLVKILLLGAGESGKSTFLKQMRIIHGREFDQKALLEFRDTIFDNILKGSRVLVDARDKLGIPWQHSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKSVSIKKHFPDFKGDPHRLEDVQRYLVQCFDRKRRNRSKPLFHHFTTAIDTENIRFVFHAVKDTILQENLKDIMLQ

SEQ ID NO: 25847 - protein, 377 aa, Mus musculus
MADFLPSRSVLSVCFPGCVLTNGEAEQQRKSKEIDKCLSREKTYVKRLVKILLLGAGESGKSTFLKQMRIIHGQDFDQRAREEFRPTIYSNVIKGMRVLVDAREKLHIPWGDNKNQLHGDKLMAFDTRAPMAAQGMVETRVFLQYLPAIRALWEDSGIQNAYDRRREFQLGESVKYFLDNLDKLGVPDYIPSQQDILLARRPTKGIHEYDFEIKNVPFKMVDVGGQRSERKRWFECFDSVTSILFLVSSSEFDQVLMEDRQTNRLTESLNIFETIVNNRVFSNVSIILFLNKTDLLEEKVQVVSIKDYFLEFEGDPHCLRDVQKFLVECFRGKRRDQQQRPLYHHFTTAINTENIRLVFRDVKDTILHDNLKQLMLQ

SEQ ID NO: 25848 - protein, 374 aa, Mus musculus
MARSLTWGCCPWCLTEEEKTAARIDQEINRILLEQKKQEREELKLLLLGPGESGKSTFIKQMRIIHGVGYSEEDRRAFRLLIYQNIFVSMQAMIDAMDRLQIPFSRPDSKQHASLVMTQDPYKVSTFEKPYAVAMQYLWRDAGIRACYERRREFHLLDSAVYYLSHLERISEDSYIPTAQDVLRSRMPTTGINEYCFSVKKTKLRIVDVGGQRSERRKWIHCFENVIALIYLASLSEYDQCLEENDQENRMEESLALFSTILELPWFKSTSVILFLNKTDILEDKIHTSHLATYFPSFQGPRRDAEAAKSFILDMYARVYASCAEPQDGGRKGSRARRFFAHFTCATDTQSVRSVFKDVRDSVLARYLDEINLL

SEQ ID NO: 25849 - protein, 354 aa, Mus musculus
MGCTLSAEERAALERSKAIEKNLKEDGISAAKDVKLLLLGAGESGKSTIVKQMKIIHEDGFSGEDVKQYKPVVYSNTIQSLAAIVRAMDTLGVEYGDKERKTDSKMVCDVVSRMEDTEPFSAELLSAMMRLWGDSGIQECFNRSREYQLNDSAKYYLDSLDRIGAGDYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYPGSNTYEDAAAYIQTQFESKNRSPNKEIYCHMTCATDTNNIQVVFDAVTDIIIANNLRGCGLY

SEQ ID NO: 25850 - protein, 394 aa, Mus musculus
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLPQYELL

SEQ ID NO: 25851 - protein, 362 aa, Mus musculus
MGDSVQILLVFMDKGAGESGKSTIVKQMRILHVNGFNGEGGEEDPQAARSNSDGEKATKVQDIKNNLKEAIETIVAAMSNLVPPVELANPENQFRVDYILSVMNLPNFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 25852 - protein, 514 aa, Mus musculus
MADYLISGGTGYVPEDGLTAHELFANADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKIQHGFSGIPITATGTMGSKLVGIVTSRDIDFLAEKDHTTLLSEVMTPRVELVVAPAGVTLKEANEILQRSKKGKLPIVNDQDELVAIIARTDLKKNRDYPLASKDSHKQLLCGAAVGTREDDKYRLDLLTQAGADVIVHDSSQGNSVYQIAMVHYIKQKYPHLQVIGGNVVTAAQAKNLIDAGVDGLRVGMGCGSICITQEVMACGRPQGTAVYKVAEYARRFGVPVIADGGIQTVGHVVKALALGASTVMMGSLLAATTEAPGEYFFSDGVRLKKYRGIGSLDAMEKSSSSQKRYFSEGDKVKIAQGVSGSIQDKGSIQKFVPYLIAGIQHGCQDIGAQSLSVLRSMMYSGELKFEKRTMSAQIEGGVHGLHSYEKRLY

SEQ ID NO: 25853 - protein, 911 aa, Mus musculus
MARPVQRFQLWSPLGFLLQLVTLLGKLGPQVQSVRPESLLFVSTWDGSLHALNKQTGDLKWTVKDDPIIQGPMYVTEMAFLSDPADGSLYVLGTHKLQGLMKLPFTIPELVHASPCRSSDGVFYTGRKQDAWFVVDPESGETQMTLTTEGLSTPQLFIGRTQYTVSMHDLRTPALRWNTTYRRYSAPLLNGSPGKYMSHLTSCGMGLLLTVDPGSGIVLWTQDLGVPVTGIYTWHQDGLHQLPHLTLARDTLHFLVLRWGHIRLPASSYQDTATQFSSLDTQLLMTLYVGKEEAGFYVSKALVHAGVALVPRGLTLAPMDGPTTDEVTLQVSGEREGSPSTAVRYPSGSVALPSQWLLIGYHEPPPVLHTTMLRVHPIPGKVSAETRASEDLHAPPVFFELLNLRREDPELHPEEKASDSYPGLGSQDLLAATFTAILLGAWVLYLMRQQQQSPSAPAGPPDLSQDAQGQLSRDILQDQRRFQSPSEPAQPPHDPEAGQPTVVGKISFNPKDVLGRGAGGTFVFRGQFEGRAVAVKRLLRECFGLVRREVQLLQESDRHPNVLRYFCTEHGPQFHYIALELCQASLQEYVESPDLDRWGLEPTTVLQQMMSGLAHLHSLHIVHRDLKPANILMAGPDSQGQGRVVISDFGLCKKLPVGRCSFSLHSGIPGTEGWMAPELLQLPPDSPTNAVDIFSAGCVFYYVLSGGSHPFGESLYRQANILSGDPCLAQLQEETHDKVVALDLVRAMLSLLPQDRPSAGWVLAHPLFWSRAKELQFFQDVSDWLEKEPDQGPLVSALEAGSYKVVREDWHKHISAPLQADLKRFRSYKGTSVRDLLRAMRNKKHHYRELPAEVRQTLGQLPAGFIQYFTQRFPRLLLHTHRAMRTCASESLFLPYYPPALEARRPDATKS

SEQ ID NO: 25854 - protein, 358 aa, Mus musculus
MAAAAAAGPEMVRGQVFDVGPRYTNLSYIGEGAYGMVCSAYDNLNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 25855 - protein, 806 aa, Mus musculus
MAEPLKEEDGEDGSGEPPGRVKAEPVHTAASVVAKNLALLKARSFDVTFDVGDEYEIIETIGNGAYGVVSSARRRLTGQQVAIKKIPNAFDVVTNAKRTLRELKILKHFKHDNIIAIKDILKPTVPYGEFRSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPVCPDVEMPSPWAPSGDCAMESPPPALPPCSDPAPDTVDLTLQPAPPASELAPPKREGAISDNTKAALKAALLKSLRSRLRDGPSAPLEAPEPRKPVTAQERQREREEKRRRRQERAKEREKRRQERERKERGAGTLGGPSTDPLAGLVLSDNDRSLLERWTRMARPPAPAPAPAPAPAPAPSSAQPTSTPTGPVSQSTGPLQPAGSIPGPASQPVCPPPGPVPQPAGPIPAPLQTAPSTSLLASQSLVPPSGLPGSGAPEVLPYFPSGPPPPDPGLTPQPSTSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLSDLPDLQEP

SEQ ID NO: 25856 - protein, 779 aa, Mus musculus
MVIMSEFSAVPSGTGQGQQKPLRVGFYDVERTLGKGNFAVVKLARHRVTKTQVAIKIIDKTRLDSSNLEKIYREVQLMKLLNHPNIIKLYQVMETKDMLYIVTEFAKNGEMFDYLTSNGHLSENEARQKFWQILSAVEYCHNHHIVHRDLKTENLLLDSNMDIKLADFGFGNFYKPGEPLSTCVGSPPYAAPEVFEGKEYEGPQLDVWSLGVVLYVLVCGSLPFDGPNLPTLRQRVLEGRFRIPFFMSQDCETLIRRMLVVDPAKRITIAQIRQHRWMQADPTLLQQDDPAFDMQGYTSNLGDYNEQVLGIMQALGIDRQRTIESLQNSSYNHFAAIYYLLLERLKEHRSAQPSSRPTPAPTRQPQLRSSDLSSLEVPQEILPCDPFRPSLLCPQPQALAQSVLQAEIDCDLHSSLQPLLFPLDTNCSGVFRHRSISPSSLLDTAISEEARQGPSLEEEQEVQEPLPGSTGRRHTLAEVSTHFSPLNPPCIIVSSSATASPSEGTSSDSCLPFSASEGPAGLGSGLATPGLLGTSSPVRLASPFLGSQSATPVLQTQAGLGTAVLPPVSFQEGRRASDTSLTQGLKAFRQQLRKNARTKGFLGLNKIKGLARQVCQSSVRTPRGGMSTFHTPAPSSGLQGCTTSNREGRSLLEEVLHQQRLLQLQHHSSTAAASSGCQQGPQLSPVPYVLAPCDSLLVSGIPLLPTPLLQAGMSPVASAAHLLDTHLHISAGPVALPTGPLPQCLTRLSPGCDPAGLPQGDCEMEDLTSGQRGTFVLVQ

SEQ ID NO: 25857 - protein, 207 aa, Mus musculus
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVSATDGLSEELTEEAFTNQLPAGLITADGQQQNVMVYTTSYQQISGVQQIQFS

SEQ ID NO: 25858 - protein, 320 aa, Mus musculus
MEEAPHGCPGADSAQAGRGASCQGCPNQRLCASGAGAAPDPAVEEIREKMKTVRHKLLVLSGKGGVGKSTFSAHLAHGLAEDGDTQVALLDIDICGPSIPKIMGLEGEQVHQSGSGWSPVYVDDNLGVMSVGFLLSSPDDAVIWRGPKKNGMIKQFLRDVDWGDVDYLIVDTPPGTSDEHLSVVQYLAAAHIDGAVILTTPQEVALQDVRKEISFCHKVKLPIIGVVENMSGFICPKCKKESQIFPPTTGGAEAMCQDLRIPLLGKVPLDPHIGKSCDKGQSFFVEAPDSPATAAYRSIIQRIRDFCNSHQSHAETLISP

SEQ ID NO: 25859 - protein, 275 aa, Mus musculus
MEAAAGERAEPGNLAGVRHIILVLSGKGGVGKSTISTELALALRHQGKKVGILDVDLCGPSIPHMLRAQGKAVHQCDNGWVPVFVDQEQSISLMSVGFLLENPDEAVVWRGPKKHALIKQFVSDVAWGQLDYLVVDTPPGTSDEHMATMEALRPYRPLGALVVTTPQAVSIGDVRRELTFCKKTGLQVIGVIENMSGFTCPHCAECTNVFSSGSGEELARLAGVPFLGSVPLDSQLTRSLEEGRDFIQEFPKSTAYSALTSIAQRVVHRMSALCS

SEQ ID NO: 25860 - protein, 469 aa, Mus musculus
MCDLIEPQPAEKIGKMKKLRRTLSESFSRIALKKEDTTFDEICVTKMSTRNCQGTDSVIKHLDTIPEDKKVRVQRTQSTFDPFEKPANQVKRVHSENNACINFKSSSAGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMEQHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTVYSSKSLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 25861 - protein, 388 aa, Mus musculus
MTRDDALPDSHSAQTFYENYEPKEILGRGVSSVVRRCIHKPTCQEYAVKIIDITGGGSFSSEEVQELREATLKEVDILQKVSGHPNIIQLKDTYETNTFFFLVFDLMKRGELFDYLTEKVTLTEKETRKIMRALLEVICTLHKLNIVHRDLKPENILLDDNMNIKLTDFGFSCQLQPGEKLREVCGTPSYLAPEIIQCSMDDGHPGYGKEVDMWSTGVIMYTLLAGSPPFWHRKQMLMLRMIMDGKYQFGSPEWDDYSDTVKDLVSRFLVVQPQDRCSAEEALAHPFFQEYVVEEVRHFSPRGKFKVICLTVLASVKIYYQYRRVKPVTREIVIRDPYALRPLRRLIDAYAFRIYGHWVKKGQQQNRAALFENTPKAVLLSLAEEEDF

SEQ ID NO: 25862 - protein, 268 aa, Mus musculus
MLLSIGMLMLSATQVYTILTVQLFAFLNLLPVEADILAYNFENASQTFEDLPARFGYRLPAEGLKGFLINSKPENACEPIVPPPLKDNSSGTFIVLIRRLDCNFDIKVLNAQRAGYKAAIVHNVDSDDLISMGSNDIDTLKKIDIPSVFIGESSANSLKDEFTYEKGGHIILVPELSLPLEYYLIPFLIIVGICLILIVIFMITKFVQDRHRNRRNRLRKDQLKKLPVHKFKKGDEYDVCAICLEEYEDGDKLRILPCSHGMSTHTVL

SEQ ID NO: 25863 - protein, 326 aa, Mus musculus
MARFAWTRVAPVALVTFWLVLSLSPTDAQVNLSSVDFLDLPALLGVPVDPKRARGYLLVARPADACHAIEGPGPDNHSLDPLVLVRPLGCSWEQTGRRAQRAGATAASVGPEAPGQLREFEDLEVTVRCDQPARVLLPHAEPCPDPECHPVVVASWALARALALAASTLFVLRQLWPWVRGLGSRGTAVKTQTCQKAQVRTFTRLSDLCAICLDDYEEGERLKILPCAHAYHCRCIDPWFSRAGASCPLCKQSVASTHDGSTDGSVGGEEPPLPGHRPPIWAIQARLRSRRLELLARTVPCRRCSSTTSLGVAENVAQSEATSELS

SEQ ID NO: 25864 - protein, 301 aa, Mus musculus
MEDEVVRIAKKMDKMVQKKNAAGALDLLKELKNIPMTLELLQSTRIGMSVNALRKQSTDEEVTSLAKSLIKSWKKLLDGPSTDKDPEEKKKEPAISSQNSPEAREESSSSSNVSSRKDETNARDTYVSSFPRAPSTSDSVRLKCREMLAAALRTGDDYVAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 25865 - protein, 765 aa, Mus musculus
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKTLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQTTSPASKKPSQEGGKGGSEKPKRPVSAMFIFSEEKRRQLQEERPELSESELTRLLARMWNDLTEKKKAKYKAREAALKAQSERKPGGEREDRGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQRQYKVHLDLWVKSLSPQDRAAYKEYISNKRKNMTKLRGPNPKSSRTTLQSKSESEEDDDEEEEDDEEEEEEEEDDENGDSSEDGGDSSESSSEDESEDGDENDDDDDDEDDEDDDDEDEDNESEGSSSSSSSSGDSSDSGSN

SEQ ID NO: 25866 - protein, 460 aa, Mus musculus
MEAARCAPGPRGDSAFDDETLRLRQLKLDNQRALLEKKQRKKRLEPLMVQPNPEARLRRLKPRGSEEHTPLVDPQMPRSDVILHGIDGPAAFLKPEAQDLESKPQVLSVGSPAPEEGTEGSADGESPEETAPKPDLQEILQKHGILSSVNYDEEPDKEEDEGGNLSSPSARSEESAAASQKAASETGASGVTAQQGDAQLGEVENLEDFAYSPAPRGVTVKCKVTRDKKGMDRGLFPTYYMHLEREENRKIFLLAGRKRKKSKTSNYLVSTDPTDLSREGESYIGKLRSNLMGTKFTVYDHGVNPVKAQGLVEKAHTRQELAAICYETNVLGFKGPRKMSVIIPGMNMNHERIPFRPRNEHESLLSKWQNKSMENLIELHNKAPVWNDDTQSYVLNFHGRVTQASVKNFQIVHGNDPDYIVMQFGRVADDVFTLDYNYPLCALQAFAIGLSSFDSKLACE

SEQ ID NO: 25867 - protein, 246 aa, Mus musculus
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLALLDKFLIKNCNDFQYESKVFYLKMKGDYYRYLAEVASGEKKNSVVEASEAAYKEAFEISKEHMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 25868 - protein, 245 aa, Mus musculus
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIENSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 25869 - protein, 245 aa, Mus musculus
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 25870 - protein, 460 aa, Mus musculus
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDESAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPPVPRPGIPPMTQAQAVSAPGILNRPPAPTAAVPAPQPPVTKPLFPSAGQAQAAVQGPVGTDFKPLNSTPAATTTEPPKPTFPAYTQSTASTTSTTNSTAAKPAASITSKPATLTTTSATSKLIHPDEDISLEERRAQLPKYQRNLPRPGQTPIGNPPVGPIGGMMPPQPGLPQQQAMRPPMPPHGQYGGHHQGMPGYLPGAMPPYGQGPPMVPPYQGGPPRPPMGMRPPVMSQGGRY

SEQ ID NO: 25871 - protein, 306 aa, Petunia x hybrida
MDGQISTPVAYFNCSNLPEQSQHPPYIPPFQVVGLAPGLVDDGGLDLQWNYGLEPKRKRPKEQDFLENNNSQISSIDFLQPRSVSTGLGLSLDNGRLASSGDSAFLGLVGDDIERELQRQDAEIDRYIKVQGDRLRQAILEKVQANQLQTVTYVEEKVIQKLREKETEVEDINKKNMELELRTEQLALEANAWQQRAKYNENLINTLKVNLEHVYAQSRDSKEGCGDSEVDDTASCCNGRATDLHLLCRDSNEMKELMTCKVCRVNEVSMLLLPCKHLCLCKECESKLSLCPLCQSTKYIGMEIYM

SEQ ID NO: 25872 - protein, 445 aa, Trypanosoma brucei
MTTKSTPSSLSVNCLVAQTEKSMDIVVNDDLSCRFLEGFNTRDALCKKISMNTCDEGDPFFVADLGDIVRKHETWKKCLPRVTPFYAVKCNDDWRVLGTLAALGTGFDCASNTEIQRVRGIGVPPEKIIYANPCKQISHIRYARDSGVDVMTFDCVDELEKVAKTHPKAKMVLRISTDDSLARCRLSVKFGAKVEDCRFILEQAKKLNIDVTGVSFHVGSGSTDASTFAQAISDSRFVFDMGTELGFNMHILDIGGGFPGTRDAPLKFEEIAGVINNALEKHFPPDLKLTIVAEPGRYYVASAFTLAVNVIAKKVTPGVQTDVGAHAESNAQSFMYYVNDGVYGSFNCILYDHAVVRPLPQREPIPNEKLYPSSVWGPTCDGLDQIVERYYLPEMQVGEWLLFEDMGAYTVVGTSSFNGFQSPTIYYVVSGLPDHVVRELKSQKS

SEQ ID NO: 25873 - protein, 834 aa, Homo sapiens
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFRRLMPFRLSSKSVDSFLQADGPEERPPAALPESTHM

SEQ ID NO: 25874 - protein, 363 aa, Oryza sativa (japonica cultivar-group); identical to SEQ ID NO: 3135

SEQ ID NO: 25875 - protein, 312 aa, Rhizobium leguminosarum
MLKNHGDGTHICYWRFPLYIGIPKTAFLPATRRAAMVAKTDIRAFETGHPLKVMDPIWDSLREEARLAAERDPVLAAFLYSTVINYHSLEECVIHRICERLDHPDMQANLLRQTFEEMLLDWPDWSSILRVDIQAIYDRDPACLRFMEAVLYFKGFHALQTHRLAHWLLNRGRRDFALYLQSRSSSVFQTDINPAARIGKGIFLDHATGLVVGETAVIGDNVSILHGVTLGGTGKEGADRHPKIGSGVMIGAGAKILGNIEIGYCSRVAAGSVVLKAVPPKKTVAGVPAKVVGEAGCSEPSRNMDQVIGADI

SEQ ID NO: 25876 - protein, 526 aa, Pseudomonas syringae pv. glycinea
MRHDARSYKEALRLILVELTQSLVKTTLLATSLILTFSLLDGFQARVSWSALAQLSGDWDLNAIQTQLLLWYVAVVSLRVGQVIYARHVLRLDLHSGRVQPVTRVLMLAGILESVVWVMLCEIALQQAFPTPVIGLLLVLFATLGNVKVSLNCAVPSLYLGRILLPVALITMWFLRVGDDLHRILGSAVLLYGLGLCRLAHSGRQRLVKQLKRQLLLDETTKRARRDLQQLRIALQRARQSNTARCQLLAGASHDLHQPLQAQGFFLAALAGSPLDSQQRQLLARARTAVKTTTDMLNTLLELSRIELGALQPTLHVFALQPLLDKLEMELAPLANGKGLSYRTLDTELLSLSDPTLLELILRNLIGNAIRYTLRGGVLIACQRCHGYLQIEVVDTGVGIALQHQQEIFRDFHQLDHPTRNNHEGLGLGLAIVARLARLLGHPLTLASREGHGSTFRVHLPLVRPVRADGETVIVPNTSRPSESLECRCRFSAFQPKPGAARHRRVSDNGVVMRGARWEEPPESSA

SEQ ID NO: 25877 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGECKVFYYKMKGDYHRYLAEFSSGDAREKATNSSLEAYKTASEIATTELPPTHPIRLFLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 25878 - protein, 361 aa, Rattus norvegicus
MAAADEPKPKKLKVEAPEALSENVLFGMGNPLLDISAVVDKDFLDKYSLKPNDQILAEDKHKELFDELVKKFKVEYHAGGSTQNSMKVAQWMIQEPHRAATFFGCIGIDKFGEILKSKAANAHVDAHYYEQNEQPTGTCAACISGGNRSLVANLRAANCYKKEKHLDLENNWMLVEKARVYYIAGFFLTVSPESVLKMARYAAENNRTFTLNLSAPFISQFFKEALMAVMPYVDILFGNETEAATFAREQGFETKDIKEIARKTQALPKVNSKRQRTVIFTQGRDDTIVATGNDVTAFPVLDQNQEEIVDTNGAGDAFVGGFLSQLVSNKPLTECIRAGHYAASVIIRRTGCTFPEKPDFH

SEQ ID NO: 25879 - protein, 361 aa, Cricetulus griseus
  unsure (1)..(361): unsure at all Xaa locations
MAAAEEPKPKKLKVEXPQALSENVLFGMGNPLLDISAVVDKDFLDKYSLKPNDQILAEEKHKELFDELVRKFKVEYHAGGSTQNSIKVAQWMIQKPHKAATFFGCIGIDKFGEILKSKAAEAHVDAHYYEQNEQPTGTCAACITGDNRSLVANLAAANCYKKEKHLDLENNWVLVEKARVYYIAGFFLTVSPESVLKVARYAAENNRIFTLNLSAPFISQFFKESLMEVMPYVDILFGNETEAATFAREQGFETKDIKEIAKKAQALAKVNSKRPRTVVFTQGRDDTVVATENEVMAFAVLDQNQKEIIDTNGAGDAFVGGFLSQLVYNKPLTECIRAGHYAASVIIRRTGCTFPEKPDFH

SEQ ID NO: 25880 - protein, 220 aa, Pinus radiata
MGRGKIEIKMIENATNRQVTFSKRRGGLKKKAQELSVLCNAEVALIIFSSTGKLHEWSSSSSFFMLQKSMKKILERYQKSEQGLGLMDYQHQQLLCEMRRITKENESLQERLRHMNGEEVNSLKLPELFKLEEQLDKAATQVRRRKDHVLENERIKQRNKMRRMEEENIILHGMNQGHMEEDNGQFNFVLYQPVKKMRTAFPAPLLRLQPNQPNLQDIGY

SEQ ID NO: 25881 - protein, 224 aa, Brassica napus
MARGKIQIKRIENQTNRQVTYSKRRNGLFKKAHELTVLCDARVSIIMFSSSNKLHEFISPNTTTKEIIDLYQTVSDVDVWSAHYERMQETKRKLLETNRNLRTQIKQRLGECLDELDIQELRSLEEEMENTFKLVRERKFKSLGNQIETTKKKNKSQQDIQKNLIHELELRAEDPHYGLVDNGGDYDSVLGYQLRFHQNHHHHYPNHALHAASASDIITFHLLE

SEQ ID NO: 25882 - protein, 146 aa, Phaseolus vulgaris
  unsure (1)..(146): unsure at all Xaa locations
MSSTEVATTTKKGGRGKPKTTKSVSRSSKAGLQFPVGRIARYLKAGRYAQRVGSGSPVYLSAVLEYLAAEVLELAGIAARDNKKSRIIPRHIQLAVRNDEELSKLMGSVTIASGGVLPKNSSKICCPRKTGKGEGEVWIYLVKGFX

SEQ ID NO: 25883 - protein, 360 aa, Cicer arietinum
LERHELVPTVWNEYGWDKVSNILYVDQPTGTGFSYSSDLRDIRHNEKGVSNDLYDFLQAFFAEHPQYAKNNFFITGESYAGHYIPALASRIRQGNQAKEGIHINLKGLAIGNGLTNPAIQYKAYADYALDMGIITKATHDRLGLVLVPACELAIKLCGTDGKLACLTANVACNLIFSDILLHAGDVNYYDIRKKCEGSLCYDFSNMEKFLNQESVRDSLGVAKISFVSCSTEVYIAMLVDWMRNLEVGIPILLEDGINLLVYAGEYDLICNWLGNSRWVHAMEWSGQKKFVASPDVPFVVNGSEAGLLKNYGPLSFLKVYDAGHMVPMDQPKAALEMLKKWTRGTLAESKVGEEEFVADM

SEQ ID NO: 25884 - protein, 274 aa, Eubacterium acidaminophilum
MDFEKANTNEYTNIKKVIAIMSGKGGVGKSSVTSLLAVSLIKKGFKVGILDGDMGGTSIPKIFGITGEKSNTSSKGIEPVTTPSGIKVMSLSFLMEKEDSPVIWRGLLISKTLRQFYTDFLWGDLDYLLIDFPPGTSDLPLTMIHSLPGGWHNNCFVPARSCKPGYRARIRNHGHSCMIVKKSADMAKRMDVPILGIIENMSYYECPDCKKRINIFGKSKTEKISKEMRIELIAHMPIDPKLAELCDEGAIEEYYNINRALVNLLSDEVLKKLS

SEQ ID NO: 25885 - protein, 182 aa, Ipomoea nil
MAGFSSSSCSVAVLLFFFLFISFTEARDHLVGGKPDAWKIPSSPSDSLNNWAQKTRFLPGDSLVWKYDGKADAVLEVSKRDYVTCNISLPIGAMVDGTRSIVLERSGPYYFISGAEGHCQKGQKVIVVVLSEKHTRKFLTAAAPSPADEVEAPAVAPTSGAVGLKGSLGVGFGLVVGLLFLM

SEQ ID NO: 25886 - protein, 256 aa, Ciona intestinalis
MSTEREDFVYQAKLAEQAERYDEMVEQMKKIAQLGISLTVEERNLLSVAYKNVIGARRASWRIISSIEMKEGSKAQMPSDYRQQVEEELKNICHDILSVIDEHLLPPSQTDQDIESQVFYHKMKGDYHRYLAEFETGDERKSAAEDSLTAYKAASDAAGKLPTTHPIRLGLALNFSVFYYEILNSPDRACRLAKEAFDQAIAELDTLSEESYKDSTLIMQLLRDNLTLWTSDMQGDADGHEGNTDEVQEMHATEAS

SEQ ID NO: 25887 - protein, 178 aa, Helicobacter pylori
MLTIKDIHALEVMDSRGNPTIQASVILSDNTKASAIVPSGASTGKREALELRDNDKTRFLGKGVLRACENVNSVIKHHLIGLEATNQAFVDERLRALDGTPNYANLGANAVLGVSMALARASAKALNLPLYRYLGGANALTLPVPMLNIINGGTHANNSIDFQEYMIMPLGFESFKEA

SEQ ID NO: 25888 - protein, 493 aa, Rattus norvegicus
MGTAKVTPSLVFAVTVATIGSFQFGYNTGVINAPETIIKDFLNYTLEERLEDLPSEGLLTTLWSLCVAIFSVGGMIGSFSVGLFVNRFGRRNSMLLVNLIAILGGCLMGFAKIAESVEMLILGRLIIGIFCGLCTGFVPMYIGEVSPTALRGAFGTLNQLGIVVGILVAQVFGLDFILGSEELWPGLLGLTIIPAILQSAALPFCPESPRFLLINRKEEDQATEILQRLWGTPDVIQEIQEMKDESIRMSQEKQVTVLELFKSPSYFQPLLISVVLQLSQQFSGINAVFYYSTGIFQDAGVQEPIYATIGAGVVNTIFTVVSLFLVERAGRRTLHMIGLGGMAVCSVFMTISLLLKDEYEAMSFVCIVAILVYVAFFEIGPGPIPWFIVAELFSQGPRPAAMAVAGCSNWTSNFLVGMFFPSAAAYLGAYVFIIFAAFLVFFLIFTFFKVPETKGRTFEDITRAFEGQAQSGKGSAGVELNSMQPVKETPGNA

SEQ ID NO: 25889 - protein, 657 aa, Drosophila melanogaster
MASASTENGEELMNYGSNSDSEESEYSENEDTQVCDKDSQQNSNADSGYPLDSPELQDSKTTGQKGQNKSGKTSIGAVHPNYGFGKRWSKSEDVLLKQLVETHGENWEIIGPHFKDRLEQQVQQRWAKVLNPELIKGPWTRDEDDMVIKLVRNFGPKKWTLIARYLNGRIGKQCRERWHNHLNPNIKKTAWTEKEDEIIYQAHLELGNQWAKIAKRLPGRTDNAIKNHWNSTMRRKYDVERRSVNASGSDLKSSRTHLITLIKSGGISKCMNNMQHNKESGGEAVNKSENADGASVTAVKGGDLAQESQDDHQKGSNLAHLSMQHLIKLTMPRQTPIILKRTRKHIPETHHQAGCSSSETFNQEEAAGNVRSRPPSSPVISPIKSLPFSPSHFLKSPCLTTFEDMDLRASTPVTKVYNRVGMEIKKEMETSSIETPHKSQLGPRTPTPFKKALAAIGKKRDGRRYEPSSPSSLVEDLAEIIHEEHLSNSLTANNSKMMGAADQNSTLSTEYNAQSPPHMKRARKSLLSTWSSNHPYNAGSAKRIQPFETETPSKFLTSPGDILKDTLCSEQDLPFDEGRKENRPFHNRRINKYRGGLTYDHVIDPKWARVACGKSRDQMFMEEQAYACLKNLSCISRSLNFEKQKCLVNSFDRFGSL

SEQ ID NO: 25890 - protein, 191 aa, Clostridium sticklandii
MREVLSLREKQKLTFMEKIKETIEVAREKDPAAKGAINILVNTPGIHAIMFHRVAHSLYNRKHFFIARLISQISRFLTGIEIHPGAQIGRRFFIDHGMGVVIGETAEIGDDVMLFHQVTLGGTGKDKGKRHPTVENNVIISAGVKVLGPIVIGENSKIGANAVVLHDIPKNATAVGIPAKVVRLNGEKVEH

SEQ ID NO: 25891 - protein, 202 aa, Prunus mume
LTHEIRGTLDRHTILKTTLVELGRTLALEECALWMPTRTGLELQLSYTLRQQNPVGYTVPIHLPVINQVFSSNRALKISPNSPVARMRPLAGKHMPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAV

SEQ ID NO: 25892 - protein, 202 aa, Prunus mume
LTHEIRSTLDRHTILKTTLVELGRTLGLQECALWMPSRAGMNLQLSHTLNYQIQVGSTVPINLPVVNEVFTSSRAIRIPYTCPLARIRPLVGRYVPPEVVALRVPLLNLSNFQINDWPDLSAKSYAIMVLILPTDSTRKWRDHELELVDVVADQVAVALSHAAILEESMRARDQLMEQNIALDLARREAEMAIHARNDFLAV

SEQ ID NO: 25893 - protein, 368 aa, Oryza sativa (japonica cultivar-group)
MPDFAQVYNFLGSIFDPETSGHLQRLREMDPIDVETVLLLMKNLSINLTNPNFEAHGNDQMKEHHHNQHPLGGDLLNGTVKFESTSVYISSKKKKKKKKKRLGAMVQGASGGGWSSKVEEGVIVGGLLVVQCILAGYVVFVDHVLSLGANPLSLIVLGAVASSLFFLPFAVVLERKKWPSKISRTLMAQFVFIALGGTTVFQELMLLGIKKTTPAIASAMPNLSPGLIFIIAACFRLEKFDKGCKYTRAKILGTLVCLVGAMAMSFLQSPVSSSPQLTTTSYYDWILGCFYLFLAVVVLSIYTVLQAATLVSFPAPLTMCSVTSMMGAVFTAILQFIVDGKIDMGSPRIDETIISTIVLMLLCLGRYL

SEQ ID NO: 25894 - protein, 310 aa, Oryza sativa (japonica cultivar-group)
MGWWLGGGLPVIAMLALNVVAAVLVSLVKVAMDGGLNPLVLVTLQQLTAAIFLGPIAYFKERKSRPKLTLEIFTYLFVSAALGAALRQYMIFVALRYTTATFVTAFSNIAPVLTFLLAILTRSESLNLRRKTGIAKLVGTLISVAGAMVLTFYKGVAVTHTTKIHHATAAAAVAAEAAMSSRNWTLGTVAILGNCVCLSCWFLLHSRLAKKYPHVYSCNAFMCMFSFLQVAVVGLSTQRNVSVWIVRTKFHILTILYAGVVGCGLSFVLLTWCIEKRGPVFVAAFIPVVQIIVSVIDFTVLHEQLFLGRF

SEQ ID NO: 25895 - protein, 137 aa, Catharanthus roseus
MASADVEFRCFVGGLAWATTDQSLSEAFSQYGEVLESKIINDRETGRSRGFGFVTFGDEKSMKDAIEGMNGQTLDGRNVTVNEAQSRGSGGGGGGGGFRGPRREGGGCYGGGGRRNGGYGGNGGGYGGGRRDGGRRW

SEQ ID NO: 25896 - protein, 164 aa, Catharanthus roseus
MASADVEYRCFVGGLAWATTDQSLSEAFSQYGEILESKIINDRETGRSRGFGFVTFKDEQSMRDAIEGMNGQTLDGRNITVNEAQSRGSGGNGGGGFRGPRRDGGGGGGYGGGRRDGGYGGNGGYGGGRREGGYGGGDRGYGGGGGGGSRYSRGGGASDGNWRN

SEQ ID NO: 25897 - protein, 160 aa, Catharanthus roseus
MASADVEFRCFVGGLAWATTDQSLSEAFSQYGEVLESKVINDRETGRSRGFGFVTFGDEKSMKDAIVGMNGQTLDGRNITVNEAQSRGSGGGGGGGGFRGPRREGGGGYGGGGRRDGGYGGNGGGYGGGRRDGGYGGGDRGYGGGDRYSRGGGSDGNWRN

SEQ ID NO: 25898 - protein, 193 aa, Gossypioides kirkii
  unsure (1)..(193): unsure at all Xaa locations
EHVGLNVNGEPFVACHECNFPICKSCFEYDLKEGRKACLRCGTPYDENLLDDVEKATGDQSTMAAQLSKPQDVGIHARHISSVSTLDSEMTEXNGNPIWKNRVESWKEKKXKKKKPATTKVEREAEXPPEQQMEDKPVPDASQPLSTIIPIPKSRLAPYRTVIILRLIILGLFFHYRVTNPVXSAFGLWLXSV

SEQ ID NO: 25899 - protein, 187 aa, Gossypioides kirkii
HVGLNGNGEPFAFCHDCNFPICKTCLDYELKEGRKACLRCGNPYDENLLDDAEKASGDRSTMAAHMAKSQDAGIHARHISSVSTLDSEMTEDNGNPIWKNRVESWKEKKNKKKKTSIKVEIEAQVPPEQLMEDKLAADAFQPLSTVIPIPKSRLAPYRTVIIMRLIILGLFFHYRVTNPVASAFALW

SEQ ID NO: 25900 - protein, 205 aa, Gossypioides kirkii
CKGYTPLFPRILGHEASGIVESVGEGVNDLKPGDHVLPIFTGECKECRYCLSEESNNMCELLRINCDRGVMLADGKTRFSINGKPIYHFVGTSTFSQYTVVHVGQVAKISPTAPLDKVCPISCGICTGFGATVNVAKPKKGQTVAIFGLGAVGLAAAEGARVCGASRIIAVDLNPRRFEEAKRFGITEFVNPKDYDKPVQEVIVE

SEQ ID NO: 25901 - protein, 271 aa, Homo sapiens
MEAAAEPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 25902 - protein, 451 aa, Homo sapiens
MHGYFGCNAAAEPGYSAFVGTPQICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 25903 - protein, 128 aa, Homo sapiens
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 25904 - protein, 374 aa, Struthio camelus
STAGKVIKCKAAVLWEPKKPFSIEEVEVAPPKAHEVRVKIIATGICRSDDHVISGVLVMPFPIILGHEAAGVVESVGEGVTSVKPGDKVIPLFVPQCGECSVCLSTKGNLCCKNDIGPASALMPDGTSRFTCKGKAIHHFAGTSTFTEYTVLHETAVAKIDAAAPLEKVCLIGCGFSTGYGAALQTAKVEPGSTCAVFGLGGVGLSVVMGCKAAGASRIIGVDINKDKFAKAKELGATDCVNPKDFTKPIHEVLMEMTGLGVDYSFEVIGHTETMAAALASCHFNYGVSVIVGVPPAAEKLSFDPMLLFSGRTWKGSVFGGWKSKDSVPKLVADYMEKKFVLDPLITHTLPFHKINEGFDLLRTGKSIRSVLLF

SEQ ID NO: 25905 - protein, 641 aa, Aeromonas veronii bv. Sobria
MVFIVKMDLTLRYLEELFVKGIAAGGVIATIPLSVNAKEDYPQKVYSSVLSGCSYRSGSRRSRCHFTGSTRIATVVNRSIPAPTLRLKEGDEVTLRVTNKLSETTSIHWHGIILPFEMDGVLGISFNGIKPGETFTYKFKLEQSGTYWYHSHSGSQEPQEQTGMYGALIIEPKDGEIISADRDYVVLLSDWTDEHPMRILAKLKSQSDYYNFNQPTAIDFVKDVSNSGLKVAFTKRQMWNEMRMNSTDLADLSSETLTYLMNGQAPSGNWTGVFNKGERVRLRFINGAGGSFYDVRVPGLKMTVVQTDGVDIEPVDVDEFRFGPGETYDVIVEPIKEAHTIFAQSMDRTGYARGTLSTAIGLSAPIPPVDKPEPLSMEDMMGSMEGMDHSSMAGMDHGSMPGMSSGEMPAMDHSSMPGMTSGAMPAMDHSSMPGMTFRCNASMDHGSMPGMEGMDHSAMLGMNTTAQPSVVRHASTEFGPSVDARVDTPRRNLNDPGVGLRNNGRRVLTLADLKTKGGPIDPRPAEREIELHLTGNMERYTWSFDGVEFGKSTPIHFNYGERVRITLHNDTMMTHPMHLHGMWSELENENGSFLVRKHTIAVQPAQRISFLVTADAIGRWAWHCHIMFHMDAGMFREVVVS

SEQ ID NO: 25906 - protein, 107 aa, Drosophila melanogaster
MDFNDEEPSCSGGAVQARTERFVVKKWVAHAMWGWDVAVDNCAICRNHIMNLCIECQADPNANQDECTVAWGECNHAFHYHCIARWLKTRLVCPLDNKEWVYQKYGR

SEQ ID NO: 25907 - protein, 300 aa, Lucilia cuprina
MGKEAADPLGFVKDFAAGGISAAVSKTAVAPIERVKLLLQVQHISKQISPDKQYKGMIDCFVRIPKEQGFASYWRGNMANVIRYFPTQALNFAFKDKYKQVFLGGVDKNTQFWRYFLGNLASGGAAGATSLCFVYPLDFARTRLAADTGKGGQREFTGLGNCLAKIFKSDGLVGLYRGFGVSVQGIIIYRAAYFGFYDTARGMLPDPKNTPIYISWAIAQVVTTVAGIVSYPFDTVRRRMMMQSGRKATEIIYKNTLHCWATIAKQEGTGAFFKGAFSNVLRGTGGAFVLVLYDEIKKFL

SEQ ID NO: 25908 - protein, 444 aa, Arabidopsis thaliana
  unsure (1)..(444): unsure at all Xaa locations
LVLLLYVCTVSCLASSKVILMRNNITLSFDDIEANIAPSVKGTGEIGVVYVAEXLDACQNLMNKXEQSSNETSPFVLIVRGGCSFEEKVRKAQRAGFKAAIIYDNEDRGTLIAMAGNSGGIRIHAVFVTKETGEVLKEYAGFPDTKVWLIPSFENSAWSIMAVSFISLLAMSAVLATCFFVRRHRIRRRTSRSSRVREFHGMSRRLVKAMPSLIFSSFHEDNTTAFTCAICLEDYTVGDKLRLLPCCHKFHAACVDSWLTSWRTFCPVCKRDARTSTGEPPASESTPLLSSAASSFTSSSLHSSVRSSALLIGPSLGSLPTSISFSPAYASSSYIRQSFQSSSNRRSPPISVSRSSVDLRQQAASPSPSPSQRSYISHMASPQSLGYPTISPFNTRYMSPYRPSPSNASPAMAGSSNYPLNPLRYSESAGTFSPYASANSLPDC

SEQ ID NO: 25909 - protein, 470 aa, Mesembryanthemum crystallinum
MNMRPALPMQTSGGNCFNELKVSGPYSSQLPVLPNPLEDFPKSPDPFAVSSSREMIPNPLQIQANPMVSHFGSSHNSSTYASGFPTDLHFPSFSPRERQSQNSPLGGGVAFPPSQNTSPDVQSAGFINYQKEDDDNSWSTGHLQDLLDFPEGIPVSNGQVGTSTEVMSNDNHVKRIGWRELTEDLYADSIEPNWNDFLADSNVADQQPKVTQPSSDVRVHQPLIQQQLSLPPREVSAAANQTSAAANQTSAAHSNRPRMRWTPELHEAFVDAVNQLGGSERATPKGVLRHMNVEGLTIYHVKSHLQKYRTARVRPESSEGNSERRASSVDPVSSVDLKTSVTITEALRMQMEVQKQLHEQLEIQRKLQLQIEEQGKYLLQMLENQNKVEKEKLNPDGSSAHNDKSEGSQPEPSREGAVISISSQGPGESSHGSKGKQKAPEADTTGDHHLEDGGSNPPPMKRARTDDSFL

SEQ ID NO: 25910 - protein, 245 aa, Vibrio parahaemolyticus
MVNKTITYDQHGKFNSQQAFIERYSVLVKRIAHHLLGRLPPSVQVEDLIQAGMIGLIEAQQNYDGSKGASFETYAGIRIRGAMLDDMRKGDWVPRSVHKNNREINQAVAELEGVLNRDPTDSEVAAHLGMSLDQYHSALTDINCSRLVGIEDLGVSDDVISPADETDDSNPFKGVADESFRKALVESIKQLPEREALVLSLYYDEELNLKEIGDVLGVSESRVSQILSQAMQRLRTKLSAWTQND

SEQ ID NO: 25911 - protein, 432 aa, Arabidopsis thaliana
MEWPWSAIAASSSSSSSCFFASPNSCLSITRRTNLSCVNTSVKSLRHSRFDSKHNLVKRRINGDSVVRRSTTSNNSTEETESSSSSSSVDCVGMGSDVECVNNGEDEENRSSGILSGGEGTFLEWTVLISPFFFWGTAMVAMKEVLPITGPFFVAAFRLIPAGLLLVAFAVYKGRPLPEGINAWFSIALFALVDATCFQILVCMLVMLVRIMVQGFLAQGLQRTSAGLGSVIIDSQPLTVAVLASFLFGESIGIVRAGGLLLGVAGLLLLEVPSVTSDGNNFSLWGSGEWWMLLAAQSMAIGTVMVRWVSKYSDPIMATGWHMVIGGLPLLAISVINHDPVFNGSLQDLSTNDVIALLYTSIFGSAVSYGVYFYSATKGSLTKLSSLTFLTPMFASIFGYLYLNETFSSLQLVGAAVTLVAIYLVNFPEGND

SEQ ID NO: 25912 - protein, 593 aa, Arabidopsis thaliana
MATEGKNPINMNSMSSSLARTGQWVFSQDIPTDVVVEVGEANFSLHKFMLVAKSNYIRKLIMESKDSDVTRINLSDIPGGPEIFEKAAKFCYGVNFEITVQNVAALHCAAEFLQMTDKYCDNNLAGRTQDFLSQVALSSLSGAIVVLKSCEILLPISRDLGIVRRCVDVVGAKACNEAMFPCRTPPNWWTEELCILDVDFFSDVVSSMKQRGVKPSSLASAIITYTEKSLRDLVRDHSGRGVKFSDPGDNESDERSQQRDLVQSIVSLLPSDKGLFPVNFLCSLLRCAVFLDTSLTCKNELEKRISVVLEHVSVDDLLIPSFTYDGERLLDLDSVRRIISAFVEKEKNVGVFNGGDFNRGVCSVSLQRVAKTVDSYLAEIATYGDLTISKFNAIANLVPKSARKSDDDLYRAIDIFLKAHPNLDEIEREKVCSSMDPLKLSYDARLHASQNKRLPVNIVLHALYYDQLKLRSGVAEQEERAVVVLPEALKTRSQLQADTTLAKENEALRSELMKMKMYVSDMQKNKNGAGASSSNSSSLVSSKKSKHTFFSSVSRKLGKLNPFKNGSKDTSHIDEDLGGVDITKPRRRRFSIS

SEQ ID NO: 25913 - protein, 619 aa, Arabidopsis thaliana
MAREHAIGEATGKRKKRGRVEEAEEYCNDGIEEQVEDEKLPLEVGMFYYPMTPPSFIVSDALEPDFPLIYVNRVFEVFTGYRADEVLGRNCRFLQYRDPRAQRRHPLVDPVVVSEIRRCLEEGIEFQGELLNFRKDGTPLVNRLRLAPIRDDDGTITHVIGIQVFSETTIDLDRVSYPVFKHKQQLDQTSECLFPSGSPRFKEHHEDFCGILQLSDEVLAHNILSRLTPRDVASIGSACRRLRQLTKNESVRKMVCQNAWGKEITGTLEIMTKKLRWGRLARELTTLEAVCWRKFTVGGIVQPSRCNFSACAVGNRLVLFGGEGVNMQPLDDTFVLNLDAECPEWQRVRVTSSPPGRWGHTLSCLNGSWLVVFGGCGRQGLLNDVFVLDLDAKHPTWKEVAGGTPPLPRSWHSSCTIEGSKLVVSGGCTDAGVLLSDTFLLDLTTDKPTWKEIPTSWAPPSRLGHSLSVFGRTKILMFGGLANIGHLKLRSGEAYTIDLEDEEPRWRELECSAFPGVVVPPPRLDHVAVSMPCGRVIIFGGSIAGLHSPSQLFLIDPAEEKPSWRILNVPGKPPKLAWGHNTCVVGGTRVLVLGGHTGEEWILNELHELCLASRQDSDL

SEQ ID NO: 25914 - protein, 361 aa, Arabidopsis lyrata subsp. petraea
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 25915 - protein, 226 aa, Arabidopsis lyrata subsp. lyrata
CKAAVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQA

SEQ ID NO: 25916 - protein, 238 aa, Arabidopsis lyrata subsp. lyrata
CKAAVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPR

SEQ ID NO: 25917 - protein, 357 aa, Arabidopsis lyrata subsp. lyrata
AVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNLLNERTLKGTFFGNYKPKTDIPGVVEKYMNKELELEKFITHTLPFSEINKAFDYMLKGE

SEQ ID NO: 25918 - protein, 104 aa, Arabidopsis lyrata subsp. lyrata
DRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGE

SEQ ID NO: 25919 - protein, 249 aa, Rosa rugosa
MEFPKQITPADDPESSSQKKLGRGKIEIKRIENTTNRQVTFCKRRNGLLKKAYELSVLCDAEVALIVFSTRGRLYEYANNSVRATIERYKKACDSSNTGSVTETNVQFYQQEASKLRRQIREIQNSNRHILGEALSTLNVKELKNLEGRLEKGISRIRSKKNEMLFAEIEYMQKREIELQNHNNFLRAKIAENDRAQQQQANMMPGTLSAYDQSMPPPQSYDRSFLPVILESNHHYNRQGQNQTPLQLV

SEQ ID NO: 25920 - protein, 248 aa, Rosa rugosa
MAYENKPNTVLDSDAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIAENERHQQSINAIAGGHGSYDIMQPTQPFHEARNYFQVNALQPNIHQYSRHDQISLQLV

SEQ ID NO: 25921 - protein, 249 aa, Rosa rugosa
MAYENKPNTVLDSDAQRRLGRGKIEIKRIENTTNRQVTFCKRRNGLLKKAYELSVLCDAEVALIVFSNRGRLYEYSNNSSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKIAENERHQQSINAIAGGHGSYDIMQPTQPFHEARNYFQVNALQPNIHQYSRHDQISLQLV

SEQ ID NO: 25922 - protein, 250 aa, Rosa rugosa
MAYENKPNTVLDSDAQRRLGRGKIEIKRIENTTNRQVTFCKRRNGLLKKAYELSVLCDAEVALIVFSNRGRLYEYSNNSVRETIERYKKACADSSNNGSVSEATTQYYQQEAAKLRAQITTLQNSNRGYMAEGLSNMSIKELKGVETKLEKAISRIRSKKNELLFAEIEYMQKRELDLHNNNQLLRAKGQIAENERHQQSINAIAGGHGSYDIMQPTQPFHEARNYFQVNALQPNIHQYSRHDQISLQLV

SEQ ID NO: 25923 - protein, 361 aa, Rattus norvegicus
MAAADEPKPKKLKVEAPEALSENVLFGMGNPLLDISAVVDKDFLDKYSLKPNDQILAEDKHKELFDELVKKFKVEYHAGGSTQNSMKVAQWMIQEPHRAATFFGCIGIDKFGEILKSKAADAHVDAHYYEQNEQPTGTCAACITGGNRSLVANLAAANCYKKEKHLDLENNWMLVEKARVYYIAGFFLTVSPESVLKVARYAAENNRTFTLNLSAPLLSQFFKEALMEVMPYVDILFGNETEAATFAREQGFETKDIKEIARKTQALPKVNSKRQRTVIFTQGRDDTIVATGNDVTAFPVLDQNQEEIVDTNGAGDAFVGGFLSQLVSNKPLTECIRAGHYAASVIIRRTGCTFPEKPNFH

SEQ ID NO: 25924 - protein, 316 aa, Rattus norvegicus
MASHLELNNGTKMPTLGLGTWKSPPGQVTEAVKVAIDMGYRHIDCAQVYQNEKEVGVALQEKLKEQVVKRQDLFIVSKLWCTFHDQSMVKGACQKTLSDLQLDYLDLYLIHWPTGFKPGPDYFPLDASGNVIPSDTDFVDTWTAMEQLVDEGLVKAIGVSNFNPLQIERILNKPGLKYKPAVNQIECHPYLTQEKLIEYCHCKGIVVTAYSPLGSPDRPWAKPEDPSLLEDPRIKEIAAKYNKTTAQVLIRFPIQRNLVVIPKSVTPARIAENFKVFDFELSNEDMATLLSYNRNWRVCALMSCAKHKDYPFHAEV

SEQ ID NO: 25925 - protein, 478 aa, Rattus norvegicus
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKNDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 25926 - protein, 533 aa, Rattus norvegicus
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKINNKANVVTSPKENIPTPALEPQTTVIHNPDGNKESTESSNTTIEDEDVKARKQEIIKVTEQLIEAINNGDFEAYTKICDPGLTAFEPEALGNLVEGMDFHRFYFENALPKINKPIHTIILNPHVHLVGDDAACIAYIRLTQYMDGNGMPKTMQSEETRVWHRRDGKWQNIHFHRSGSPTVPIKPPCIPNGKENFSGGTSLWQNI

SEQ ID NO: 25927 - protein, 502 aa, Rattus norvegicus
MSCAGNDQAAASGSSSGSGGIFRSPAAKMLKVTVPSCPSSPCSSVTSSTENLVPDYWIDGSKRDPLSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVKKLIVLDPKKRLTTFQALQHPWVTGKAANFVHMDTAQKKLQEFNARRKLKAAVKAVVASSRLGSASSSHTNIQESNKASSEAQPAQDGKDKTDPLENKMQAGDHEAAKAAADETMKLQSEEVEEEEGVKEEEEEEEEEEETSRMVPQEPEDRLETDDQEMKRNSEETLKSVEEEMDPKAEEEAAAVGLGVPPQQDAILPEY

SEQ ID NO: 25928 - protein, 524 aa, Rattus norvegicus
MPSVYGFPAFTSATELLLAVTTFCLGFWVVRVTRTWVPKGLKSPPGPWGLPFIGHVLTLGKNPHLSLTKLSQQYGDVLQIRIGSTPVVVLSGLNTIKQALVKQGDDFKGRPDLYSFTLIANGQSMTFNPDSGPLWAARRRLAQNALKSFSIASDPTLASSCYLEEHVSKEAEYLISKFQKLMAEVGHFDPFKYLVVSVANVICAICFGRRYDHDDQELLSIVNLSNEFGEVTGSGYPADFIPILRYLPNSSLDAFKDLNKKFYSFMKKLIKEHYRTFEKGHIRDITDSLIEHCQDRRLDENANVQLSDDKVITIVFDLFGAGFDTITTAISWSLMYLVTNPRIQRKIQEELDTVIGRDRQPRLSDRPQLPYLEAFILETFRHSSFVPFTIPHSTIRDTSLNGFYIPKGHCVFVNQWQVNHDQELWGDPNEFRPERFLTSSGTLDKHLSEKVILFGLGKRKCIGETIGRLEVFLFLAILLQQMEFNVSPGEKVDMTPAYGLTLKHARCEHFQVQMRSSGPQHLQA

SEQ ID NO: 25929 - protein, 788 aa, Rattus norvegicus
MSDGQWVCLSSEEFDQLQKYSEYSSKKIKDVLAEFNEGGSLKQYDPHKPISYDVFKLFMRAYLEVDLPQPLSTNLFLAFSQKPRQETPDHPKEGASSSEPNVSDSNAESTAKADAACAPDTESKPIKTQVPSEELEAAAPWGEPNAPASSSDAPIVYLKDVVCYLSLMETGRPQDKLEFMFRLYDSDENELLDQAELDQIVSQMLHVAQYLEWDPTELRPILKEMLQGMDYNKDGFVSLEEWVSGGMTTIPLLVLLGMDDSASKGDGRHAWTLKHFKKPTYCNFCHIMLMGVRKQGLCCIYCKYAVHQRCVSNSIPGCVKTYSKAKRSGEVMQHAWVEGNSSVKCDRCHKSIKCYQSVTARHCVWCRMTFHRKCELSTACDGGELKDHILLPTSIYPVTRDRQAGKSDSGAAAKGELVMQYKIIPSPGTHPLLVLVNPKSGGRQGERILQKFHYLLNPKQVFNLDKGGPTPGLNFFQDTPDFRVLACGGDGTVGWILDCIDKANFTKHPPVAVLPLGTGNDLARCLRWGGGYEGGSLTKILKEIEQSPLVMLDRWYLEVMPREEVENGDQVPYNIMNNYFSIGVDASIAHRFHVMREKHPEKFNSRMKNKLWYFEFGTSETFAATCKKLHDHIELECDGVEVDLSNIFLEGIAILNIPSMYGGTNLWGETKKNRAVIRESRKSVTDPKELKCCVQDLSDQLLEVVGLEGAMEMGQIYTGLKSAGRRLAQCSSVTIRTKKLLPMQVDGEPWMQPPCMIKITHKNQAPMMMGPPQKSSFFSLRRKSRSKD

SEQ ID NO: 25930 - protein, 363 aa, Rattus norvegicus
MVDHAPFETDISTLTRFVLEEGRKAGGTGEMTQLLNSLCTAIKAISSAVRQAGIAQLYGIAGSTNVTGDQVKKLDILSNDLVINMLKSSYATCVLVSEEDTHAIIIEPEKRGKYVVCFDPLDGSSNIDCLASIGTIFGIYRKTSANEASEKDALQPGRNLVAAGYALYGSATMLVLAMNCGVNCFMLDPSIGEFILVDRDVKIKKKGNIYSINEGYAKDFDPAINEYIQRKKFPPDNSAPYGARYVGSMVADVHRTLVYGGIFLYPANKKNPSGKLRLLYECNPIAYVMEKAGGLATTGNEDILDIVPTEIHQKAPVIMGSTEDVQEFLEIYNKDKAKSRPSLPLPQSRARESPVHSICDELF

SEQ ID NO: 25931 - protein, 379 aa, Oryza sativa; identical to SEQ ID NO: 3891

SEQ ID NO: 25932 - protein, 379 aa, Oryza sativa; identical to SEQ ID NO: 3078

SEQ ID NO: 25933 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMAPFGPYWKFVRKLIMNDLLNATTVNKLRPLRTQQIRKFLRVMAQGAEAQKPLDLTEELLKWTNSTTSMMMLGEAEEIRDIAREVLKIFGEYSLTDFIRPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDSKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 25934 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKLLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVIEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 25935 - protein, 500 aa, Vicia villosa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSLVAMVPFGPYWKFVRKLIMNDLLNATTVNKLRPLRTQQIRKFLRVMAQGAEAQKPLDLTEELLKWTNSTISMMMLGEAEEIRDIAREVLKIYGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGIDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRGMCPGVNLATSGMATLLASLIQCFDLQVLGPQGQILKGGDAKVSMEERAGLTVPRAHSLVCVPLARIG

SEQ ID NO: 25936 - protein, 500 aa, Lens culinaris
FLHLRPTPTAKSKALRHLPNPPSPKPRLPFIGHPHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDILVDEVDTQNLPYIRAIVKETFRMHPPLPVVKRKCTEECEINGHVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 25937 - protein, 500 aa, Lens culinaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMVLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGCVTPEGALILFNVWQVGRDPKYWDRPSEFRPERFLETGAEGEARPLDLRGRHFQLLPFGSGRRMCPGVNLATSGMATLLASLIQCFDLQVLGPQGQILKGGDAKVSMEERAGLTVPRAHSLVCVPLARIG

SEQ ID NO: 25938 - protein, 522 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEAYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLSK

SEQ ID NO: 25939 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRAMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 25940 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 25941 - protein, 521 aa, Vigna radiata
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAEATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 25942 - protein, 500 aa, Lupinus albus
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVARVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVLLDTLLEFAEDETMEIKITKDHIKGLVVDFFSAGTDSTAVATEWALAELINNPKVLERAREEVYSVVGKDRLVDEVDTQNLPYIRAIVKETFRMHPPLPVVKRKCTEECEINGYVIPEGALILFNVWQVGRDPKYWDRPSEFRPERFLETEAEGEARPLDLRGQHFQLLPFGSGRRMCPGVILATSGMATLLASLIQCFDLQVLGPQGQILKGGDAKVSMEERAGLTVPRAHSLVCVPLARIG

SEQ ID NO: 25943 - protein, 499 aa, Trifolium repens
SHLRPTPSAISKALRHLPNPPSPRPRLPFIGHLHLLKDKLLHYAPIDLSKKHGPLFSLSFGSMPTVVASTPELFKLFLQTHEATSFNTRFQTSAIRHLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVVTEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSESRPERFLETGAEGEAGPLDLRGQHFQLLPFGSGRRMCPGVSLATSGMATLLASLIQCFDLQVLGPQGQILKGDDAKVSMEERAGLTVPRAHSLVCVPLARIG

SEQ ID NO: 25944 - protein, 500 aa, Trifolium repens
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPKVLQKAREEAYSVVGKDRLVDEVDTQNLPYIRAIVKETFRMHPPLPVVKRKCTEECGINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 25945 - protein, 499 aa, Beta vulgaris
LHLRPTPTAKSKALRHLPNPPSPKPRLPFIGHLHLLKDKLLHYALIDLSKKHGPLFSHYFGSMPTVVASTPELFKLFLQTNEATSFNTRFQTSAIRRLTYDSSVAMVPFGPYWKFVRKLIMNDLLNATTVNKLRPLRTQQIRKFLRAMAQGAEARKPLDLTEELLKWANSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHTKGLVVDFFSAGTDSTAVATEWALAELINNPKVLEKAREEVYSVVGKDRLVDEVDTQNLPYIRAIVKETFRMHPPLPVVKRKCTEECEINGYVIPEGALIPFNVWQVGRDPKYWDRPSEFRPERFLETGAEGEARPLDLRGQHFQLLPFGSGRRMCPGVNLATSGTATLLASLIQCFDLQVLGPQGQILKGGDAKVSMEERAGLTVPRAHSLVCVPLARIG

SEQ ID NO: 25946 - protein, 500 aa, Beta vulgaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEDVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCIEECEINGYVIPEGALILFNVWQVGRDPKYWDRPSEFRPERFLETGAEGEARLLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 25947 - protein, 447 aa, Paracoccidioides brasiliensis
MAPFVFAPHDIYVTRNYPDDSSNYKSSTHHGGFDLFQARDASKDLIFDILKKKVSEIDVHNCHPGEEDPFYVADLGQVYRQHIRWKKNLGRVKPFYAVKCNPDPQILRLMVQLGNGFDCASKAEIDYALDVGVDPSRIIYAQPCKTKSFLRYASQVGVKQMTFDNSDELYKIKEMCPDAELYLRILTDDSASLCRLSMKFGASLSVARSLLELAKELKLNVIGVSFHVGSGAEDPKSFVKAVEDSRFVFDQAAEVGFDLKVLDVGGGFSEDTFERFAATLSDALDEYFPPHIRIIAEPGRYYVASAFTLAANVIARRDVSLEMSDSDSTAGATEAYMIYLNDGVYGNFSNIIFDHQHPVPQILTMESRVCAPIEYSIWGPTCDGIDLICERIALPELDVGNWLYFENMGAYTKCSATRFNGFTDKHEVIYISTEPSATALLELSNEL

SEQ ID NO: 25948 - protein, 320 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKEFYCVGIQG

SEQ ID NO: 25949 - protein, 128 aa, Gallus gallus
SGRGKQGGKARAKAKSRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTDSHKAKAK

SEQ ID NO: 25950 - protein, 103 aa, Gallus gallus
MSGRGKGGKGLGKGGAKRHRKVLRDNIQGITKPAIRRLARRGGVKRISGLIYEETRGVLKVFLENVIRDAVTYTEHAKRKTVTAMDVVYALKRQERTLYGFGG

SEQ ID NO: 25951 - protein, 315 aa, Cricetulus griseus
STFVELSTKAKMPIVGLGTWQSPPGQVKEAVKVAIDAGYRHIDCAYAYYNEHEVGEAIQEKIKEKAVRREDLFIVSKLWPTCFERKLLKEAFQKTLTDLKLDYLDLYLIHWPQGLQPGKELFPKDDQGNVLTSKITFLDAWEVMEELVDEGLVKALGVSNFNHFQIERILNKPGLKHKPVTNQVECHPYLTQEKLIEYCHSKGITVTAYSPLGSPNRPWAKPEDPSLLEDPKIKEIAAKHKKTSAQVLIRFHIQRNVVVIPKSVTPARIHENFQVFDFQLSDQEMATILGFNRNWRACLLPETVNMEEYPYDAEY

SEQ ID NO: 25952 - protein, 509 aa, Rattus norvegicus
MPSGFQQIGSEDGEPPQQRVTGTLVLAVFSAVLGSLQFGYNIGVINAPQKVIEQSYNATWLGRQGPGGPDSIPQGTLTTLWALSVAIFSVGGMISSFLIGIISQWLGRKRAMLANNVLAVLGGALMGLANAAASYEILILGRFLIGAYSGLTSGLVPMYVGEIAPTHLRGALGTLNQLAIVIGILVAQVLGLESMLGTATLWPLLLAITVLPALLQLLLLPFCPESPRYLYIIRNLEGPARKSLKRLTGWADVSDALAELKDEKRKLERERPLSLLQLLGSRTHRQPLIIAVVLQLSQQLSGINAVFYYSTSIFELAGVEQPAYATIGAGVVNTVFTLVSVLLVERAGRRTLHLLGLAGMCGCAILMTVALLLLERVPSMSYVSIVAIFGFVAFFEIGPGPIPWFIVAELFSQGPRPAAMAVAGFSNWTCNFIVGMGFQYVADAMGPYVFLLFAVLLLGFFIFTFLRVPETRGRTFDQISATFRRTPSLLEQEVKPSTELEYLGPDEND

SEQ ID NO: 25953 - protein, 354 aa, Rattus norvegicus
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDAARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 25954 - protein, 354 aa, Rattus norvegicus
MGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARADDARQLFVLAGSAEEGVMTSELAGVIKRLWRDGGVQACFSRSREYQLNDSASYYLNDLDRISQTNYIPTQQDVLRTRVKTTGIVETHFTFKELYFKMFDVGGQRSERKKWIHCFEGVTAIIFCVALSDYDLVLAEDEEMNRMHESMKLFDSICNNKWFTDTSIILFLNKKDLFEEKIKRSPLTICYPEYTGSNTYEEAAAYIQCQFEDLNRRKDTKEVYTHFTCATDTKNVQFVFDAVTDVIIKNNLKECGLY

SEQ ID NO: 25955 - protein, 355 aa, Rattus norvegicus
MGCRQSSEEKEAARRSRRIDRHLRSESQRQRREIKLLLLGTSNSGKSTIVKQMKIIHSGGFNLEACKEYKPLIIYNAIDSLTRIIRALAALKIDFHNPDRAYDAVQLFALTGPAESKGEITPELLGVMRRLWADPGAQACFGRSSEYHLEDNAAYYLNDLERIAAPDYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLSEKIRRIPLSVCFPEYKGQNTYEEAAVYIQRQFEDLNRNKETKEIYSHFTCATDTSNIQFVFDAVTDVIIQNNLKYIGLC

SEQ ID NO: 25956 - protein, 461 aa, Rattus norvegicus
MGSFTKEEFDCHILDEGFTAKDILDQKINEVSSSDDKDAFYVADLGDVLKKHLRWLKALPRVTPFYAVKCNDSRAIVSTLAAIGTGFDCASKTEIQLVQGLGVPPERIIYANPCKQVSQIKYAASNGVQMMTFDSEIELMKVARAHPKAKLVLRIATDDSKAVCRLSVKFGATLKTSRLLLERAKELNIDVIGVSFHVGSGCTDPETFVQAVSDARCVFDMGTEVGFSMYLLDIGGGFPGSEDTKLKFEEITSVINPALDKYFPSDSGVRIIAEPGRYYVASAFTLAVNIIAKKTVWKEQTGSDDEDESNEQTLMYYVNDGVYGSFNCILYDHAHVKALLQKRPKPDEKYYSSSIWGPTCDGLDRIVERCSLPEMHVGDWMLFENMGAYTVAAASTFNGFQRPNIYYVMSRSMWQLMKQIQSHGFPPEVEEQDVGTLPMSCAQESGMDRHPAACASASINV

SEQ ID NO: 25957 - protein, 199 aa, Rattus norvegicus
MSWLLGYVDPTEPSFVAAVLTIVFNPLFWNVVARWEQRTRKLSRAFGSPYLACYSLGSIILLLNILRSHCFTQAMMSQPKMEGLDSHTIYFLGLALLGWGLVFVLSSFYALGFTGTFLGDYFGILKESRVTTFPFSVLDNPMYWGSTANYLGWALMHASPTGLLLTVLVALVYVVALLFEEPFTAEIYRRKATRLHKRS

SEQ ID NO: 25958 - protein, 334 aa, Rattus norvegicus
MVQVFWSYLWRVSAPQMTPSSAEGGRKMEAGGCVCGKHNVEPYSDWDSLSLLAPKAILTVSVCLLWRASQKSHHLPAASKCQIVPHTLRSHAAVGDPGSPCRPHLQSPDIQLRFGGNWSDVYGSRSLKYKEFLLEDGEHVTQVSGTRKLCLTSLSFTTNKGRVVTFGVRRGLSFNESGGSDKYLVTVNGLYAPGLCLNGMGFKWKNIHDDFDDNDDDKEDDDDEHDDDNEEDHGDKDNDNDHDDDHDDDDDDKEDDNEEDVDDERDDKDDDEEDDDNDKENDKDDGEGSGDDDDNDDEDDDKDDDGGSGDDGDDGDDDEDDDGGDDDNGDEEEE

SEQ ID NO: 25959 - protein, 426 aa, Rattus norvegicus
MSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLSAIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 25960 - protein, 522 aa, Rattus norvegicus
MSEDKITGTLAFTVFTAVLGSFQFGYDIGVINAPQEVIISHYRHVLGVPLDDRRATINYDINGTDTPLIVTPAHTTPDAWEEETEGSAHIVTMLWSLSVSSFAVGGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDYWHILLGLSAVPALLQCLLLLFCPESPRYLYLNLEEEVRAKKSLKRLRGTEDITKDINEMRKEKEEASTEQKVSVIQLFTDPNYRQPIVVALMLHLAQQFSGINGIFYYSTSIFQTAGISQPVYATIGVGAINMIFTAVSVLLVEKAGRRTLFLAGMIGMFFCAVFMSLGLVLLDKFTWMSYVSMTAIFLFVSFFEIGPGPIPWFMVAEFFSQGPRPTALALAAFSNWVCNFIIALCFQYIADFLGPYVFFLFAGVVLVFTLFTFFKVPETKGKSFDEIAAEFRKKSGSAPPRKATVQMEFLGSSETV

SEQ ID NO: 25961 - protein, 820 aa, Rattus norvegicus
MMLRWSGIWGLYPPRIFPSLLVVVALVGLLPVLRSHGLQLNPTASTIRGSEPPRERSIGDVTTAPSEPLHHPDDRNLTNLYIEHGAKPVRKAFPVLDIDYLHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLLYAVCLVGGEQINNIGLLDTLLFGSIISAVDPVAVLAVFEEIHINELLHILVFGESLLNDAVTVVLYHLFEEFASYEYVGISDIFLGFLSFFVVSLGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHQWNWTFVISTLLFCLIARVLGVLVLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSAASERILPALSKDKEEEIRKILRSNLQKTRQRLRSYNRHTLVADPYEEAWNQMLLRRQKARQLEQKITNYLTVPAHKLDSPTMSRARIGSDPLAYEPKADLPVITIDPASPQSPESVDLVNEELKGKVLGLKRGPRTTPEEEEEDEDGVIMIRSKEPSSPGTDDVFTPGPSDSPGSQRIQRCLSDPGPHPEPGEGEPFIPKGQ

SEQ ID NO: 25962 - protein, 697 aa, Rattus norvegicus
MVGLLLGGIIFGVDEKSPPAMKTDVFFLYLLPPIVLDAGYFMPTRPFFENLGTIFWYAVVGTLWNSIGIGLSLFGICQIEAFGLSDITLLQNLLFGSLISAVDPVAVLAVFENIHVNEQLYILVFGESLLNDAVTVVLYNLFKSFCQMKTIQTVDVFAGIANFFVVGIGGVLIGILLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLIWRALGVFVLTQVINWFRTIPLTFKDQFIIAYGGLRGAICFALVFLLPATVFPRKKLFITAAIVVIFFTVFILGITIRPLVEFLDVKRSNKKQQAVSEEIHCRFFDHVKTGIEDVCGHWGHNFWRDKFKKFDDKYLRKLLIRENQPKSSIVSLYKKLEIKHAIEMAETGMISTVPSFASLNDCREEKIRKLTPGEMDEIREILSRNLYQIRQRTLSYNRHNLTADTSERQAKEILIRRRHSLRESLRKDNSLNRERRASTSTSRYLSLPKNTKLPEKLQKKNKVSNADGNSSDSDMDGTTVLNLQPRARRFLPDQFSKKASPAYKMEWKNEVDVGSARAPPSVTPAPRSKEGGTQTPGVLRQPLLSKDQRFGRGREDSLTEDGPPKPPPRLVRRASEPGNRKGRLGNEKP

SEQ ID NO: 25963 - protein, 831 aa, Rattus norvegicus
MWHPALGPGWKPLLALAVAVTSLRGVRGIEEEPNSGGSFQIVTFKWHHVQDPYIIALWILVASLAKIVFHLSHKVTSVVPESALLIVLGLVLGGIVWAADHIASFTLTPTLFFFYLLPPIVLDAGYFMPNRLFFGNLGTILLYAVIGTIWNAATTGLSLYGVFLSGLMGELKIGLLDFLLFGSLIAAVDPVAVLAVFEEVHVNEVLFIIVFGESLLNDAVTVVLYNVFESFVTLGGDAVTGVDCVKGIVSFFVVSLGGTLVGVIFAFLLSLVTRFTKHVRIIEPGFVFVISYLSYLTSEMLSLSAILAITFCGICCQKYVKANISEQSATTVRYTMKMLASGAETIIFMFLGISAVDPVIWTWNTAFVLLTLVFISVYRAIGVVLQTWILNRYRMVQLETIDQVVMSYGGLRGAVAYALVVLLDEKKVKEKNLFVSTTLIVVFFTVIFQGLTIKPLVQWLKVKRSEQREPKLNEKLHGRAFDHILSAIEDISGQIGHNYLRDKWSNFDRKFLSKVLMRRSAQKSRDRILNVFHELNLKDAISYVAEGERRGSLAFIRSPSTDNMVNVDFSTPRPSTVEASVSYFLRENVSAVCLDMQSLEQRRRSIRDTEDMVTHHTLQQYLYKPRQEYKHLYSRHELTPNEDEKQDKEIFHRTMRKRLESFKSAKLGINQNKKAAKLYKRERAQKRRNSSIPNGKLPMENLAHNFTIKEKDLELSEPEEATNYEEISGGIEFLASVTKDVASDSGAGIDNPVFSPDEDLDPSILSRVPPWLSPGETVVPSQRARVQIPNSPSNFRRLTPFRLSNKSVDSFLQADGPEEQLQPASPESTHM

SEQ ID NO: 25964 - protein, 505 aa, Rattus norvegicus
MTSKPHSDWIPYSVLDDEGSNLRQQKLDRQRALLEQKQKKKRQEPLMVQANADGRPRSRRARQSEEQAPLVESYLSSSGSTSYQVQEADSLASVQPGATRPPAPASAKKTKGAAASGGQGGAPRKEKKGKHKGTSGPATLAEDKSEAQGPVQILTVGQSDHAKDAGETAAGGGAQPSGQDLRATMQRKGISSSMSFDEEEDEDENSSSSSQLNSNTRPSSATSRKSTREAASAPSPAAPEPPVDIEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVCIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 25965 - protein, 214 aa, Oryza sativa (japonica cultivar-group)
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 25966 - protein, 317 aa, Euphorbia esula
ATSKAEKKIAYDAKLCQLLDDYSQILVVAADNVGSTQLQNIRKGLRGDSVVLMGKNTMMKRSVRVHSEKTGNTAFLNLLPLLQGNVGLIFTKGDLKEVSEEVAKYKVGAPARVGLVAPIDVVVPPGNTGLDPSQTSFFQVLNIPTKINKGTVEIITPVELIKKGDKVGSSEAALLAKLGIRPFSYGLVVQTVYDSGTVFSPEVLNLTEDDLMAKFAIGVSMITSLALSVSYPTLAAAPHMFINAYKNVLAIAVSTDYSFPQADKVKEYLADPSKFAVALAPVAAAAPADAPAASKEEEKKDEPADESDDDLGFSLFD

SEQ ID NO: 25967 - protein, 329 aa, Euphorbia esula
MTTDFKTIPIIDISSLVSKCDEPGMAQDPTVCEVVKQLDQACREAGFFYVRGHGIPDSLIKEVKSLAHKFFHLPYEEKLKIKMTPAAGYRGYQRVGENVTKGTPDMHEAIDCYKEVTPGMYGALGKPMEGCNQWPLNLPNFKSLMEEYVSLCTDLSRKILRGIALTLCGSADALEGEIGGNPFWVLRIIGYPDVSSVKGHDSNENDIGCGAHPDYGLLTLVNQDDDITALEVRNMSGEWIAAPPIPGTFVCNIGDMLKIWSNGLYDSTLHRVVNNSPKYRVCVAYFHEPNFDAAIEPSEFCVKKTGGTRRSGKAVYGEHLVSKVQTNFG

SEQ ID NO: 25968 - protein, 736 aa, Mycobacterium leprae
MLRKHTSSVQCARIDADCREVFGDVLGEHAMTIRLCGSWSVGDIEANYMMYSRIAGHCCRPVFVTHRRLTLPKRWLGYPFGAPTLALPEYNNGMLEQIRRPADLQHLSQQQLRDLAAEIRELLVHKVAATGGHLGPNLGVVELTLALHRVFDSPHDPIIFDTGHQAYVHKMLTGRCQDFDSLRKKAGLSGYPSRAESEHDWVESSHASTALSYADGLAKAFELAGNRNRHVVAVVGDGALTGGMCWEALNNIAATPRPVVIVVNDNGRSYAPTIGGVADHLATLRLQPAYERLLEKGRDALHSLPLIGQIAYRFMHSVKAGIKDSLSPQLLFTDLGLKYVGPVDGHDEHAVEVALRKARGFGGPVIVHVVTRKGMGYPPAEADQAEQMHTCGVMDPTTGQPTKIAAPDWTAIFSDALIGYAMKRRDIVAITAAMPGPTGLTAFGQCFPDRLFDVGIAEQHAMTSAAGLAMGRMHPVVAIYSTFLNRAFDQIMMDVALHKLPVTMVIDRAGITGSDGPSHNGMWDLSMLGIVPGMRVAAPRDAIRLREELGEALDVDDGPTAIRFPKGDVCEDIPALKRRSGVDVLAVPATGLAQDVLLVGVGVFASMALAVAKRLHNQGIGVTVIDPRWVLPVCDGVLELAHTHKLIVTLEDNGVNGGVGAAVSTALRQVEIDTPCRDVGLPQEFYDHASRSEVLADLGLTDQDVARRITGWVVAFGHCGSGDDAGQYGPRSSQTM

SEQ ID NO: 25969 - protein, 442 aa, Avena fatua
MGAGAEPVEVEEGAAGKEEIGAAGKEEKTAVSCSICLDAVVAAAGGDRSTARLQCGHEFHLDCIGSAFNAKGVMQCPNCRKIEKGNWLYANGSRPSQDVNMDEWAHDEDLYDVSYSEMPFRFHWCPFGRLAQLPSFFEEGESSPPVTFHDFMGQHVFPEHLSVPAAPGAHPCPYVAYLQPLPSLASSSSSHVPERTMDSSVYHDHWNHLAGPSDGRPLQSVQPTDFHHNHWGHLPHSYAQSNSNNGVTEQPGVPFGTMRAARVDGDSQRRGSVFSPSYFSNGSGSRSRAPNVPPLVPQFMRAHSSLNEQYLQNPSSSLFAGAHRSGGMRPAPPPPQPENPTFCLFPPGSSGHSSMETDDAGGNRFYAWERDRFAPYPLMPVDCETSWWSSQQSHGASESTPAPAPAPAPRRLFGQWIGLGRSSPENRSPEGTSYRQMHSPRM

SEQ ID NO: 25970 - protein, 310 aa, Arabidopsis thaliana
MDASSSPSPSEESLKLELDDLQKQLNKKLRFEASVCSIHNLLRDHYSSSSPSLRKQFYIVVSRVATVLKTRYTATGFWVAGLSLFEEAERLVSDASEKKHLKSCVAQAKEQLSEVDNQPTESSQGYLFEGHLTVDREPPQPQWLVQQNLMSAFASIVGGESSNGPTENTIGETANLMQELINGLDMIIPDILDDGGPPRAPPASKEVVEKLPVIIFTEELLKKFGAEAECCICKENLVIGDKMQELPCKHTFHPPCLKPWLDEHNSCPICRHELPTADQKYENWKEREKEAEEERKGAENAVRGGEYMYV

SEQ ID NO: 25971 - protein, 706 aa, Homo sapiens
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKGAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 25972 - protein, 444 aa, Lupinus luteus
MATIATIKARQIFDSRGNPTVEVDLTLSDGTFARAAVPSGASTGIYEALELRDGGSDYLGKGVSKAVDNVNTIIAPALIGKDPTEQTAIDNFIVQELDGTVNEWGWGKQKLGANAILAVSLAVCKAGASALKIPLYKHIANLAGNKNLVLPVPAFNVINGGSHAGNKLAMQEFMILPVGASTFKEALKIGVEVYHNLKSVIKKKYGQDAVNVGDEGGFAPNIQENKEGLELLKSAIAKAGYTDKVVIGMDVAASEFYTSDKKYVLNFKEDNNDGSQKISGEELKELYKSFVAEYPIASIEDPFDQDDWEHYGKITTEIGTEVQIVGDDLLVTNPKRVQKAIDSKSCNALLLKVNQIGSVTESIEAVKMSKKAGWGVMTSHRSGETEDTFIADLAVGLSTGQIKTGAPCRSERLAKYNQLLRIEEELGDEAVYAGVNYRNPVEPY

SEQ ID NO: 25973 - protein, 312 aa, Methanothermobacter thermautotrophicus
MLFDAVGLGALNMDQLHMVERIAGPDEEVFVRSILESCGGSAANTIIGLARLGLRTAFIGKVAGDREGSILRENLKGGGVADYVAVSDEGRSGRVMGFVDPQGNRALYVDPGVNDTLSMDEVREEALKTRLLHLTSFAGSGIRVQREVLGVIDDSVTVSLDPGHLYAERGASELEGILERTDILLVNRRELEILTGSPDPAMASAELGVDVVVMKMGSEGVRAFDGSEVMVEALETSCRDTTGAGDAFNAGFLYAWLSGHGLEVSCLFGNYMASRCIEGYGATSSLPGREALEVLEGYLRDTYQEKRGDSGK

SEQ ID NO: 25974 - protein, 346 aa, Asterina pectinifera
MSKEFFWGDSLTGTKKEVKWNPSLDDEDDFDNLDSDGIQHFLFLKQAVLGANAKEGERNVVEIETENFDGDNVKQPLFSLKLGLNESSPLDIGIQPPVTFILTAGSGPVFLSGQHMIEISADDEEELEEDDEEEEEEDEVEVNASPDLPVAKSKKRPLSTSDGTAKKTKMAKLDKDADKKEDDDEEEDDEEEDEVMAMMDDDEDDEDDEDFEGGEDDEEEDEEESDEDEDDEDDNEEEEEEDEDEESPEKPLKTTAKGKKGQMNGTTTAKGDNKPKAKAKTDTKLVKGKAKKKVLALDEIKGKLQESSNVPKKEEKFKNYVRSAFHISEAKKLQDLWGWFRASLQK

SEQ ID NO: 25975 - protein, 258 aa, Mus musculus
MSQERPTFYRQELNKTIWEVPERYQNLSPVGSGAYGSVCAAFDTKTGHRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESDAKP

SEQ ID NO: 25976 - protein, 803 aa, Chenopodium rubrum
MAGRLTRVPSLKERLDETLTAQRNEILSFLSRIVSHGKGILQPHELLSEFEAVSDKHKLADGPFGEVFRHTQEAIVLPPWITLAVRPRPGVWEYIRVNVDELAVEELTPSQFLHVKEELVDGSVNGNFVLDELDFEPFNASFPRPTLSKSIGNGVEFLNRHLSAKMFHDKESMRPLLDFLRMHHYKGKTMMLNDRIQNLDSLQSVLRKAEEFLATLPADTPYSEFDHKFQEIGLERGWGDTAERVMDMIQLLLDLLEAPDSCTLEKFLGRIPMVFNVVILSPHGYFAQANVLGYPDTGGQVVYILDQVRALENEMLQRIKQQGLDIIPRILIVSRLLPDAVGTTCGQRLEKVFGTEHSHILRSLQTEKGIVRRWISRFEVWPYLETYTEDVANEIAGELQAKPDLIIGNYSDGNIVASLLAHKLGVTQCTIRHALEKTKYPNSDIYWKSFEEKYHFSCQFTADLIAMNHTDFIITSTFQEIAGNKDTVGQYESHMAFTLPGLYRVVHGIDVFDPKFNIVSPGADLSIYFPYTEEKKRLKALHPEIEELLYSEVQNEEHICVLKDRNKPIIFSMARLDRVKNMTGLVEWYGKNKKLRQLVNLVVVAGDRRKESKDIEEKEEMKKMYGLIEEYNLNGQFRWISAQMNRVRNGELYRYIADTKGAFVQPAYYEAFGLTVVEAMTCGLPTFATCHGGPAEIIVNGKSGYHIDPYHGDKAAELLVEFFEKSTANPSHWEAISNGGLKRIEEKYTWKIYSDRLLTLAGVYGFWKYVSNLDRREARRYLEMFYALKYKKPAESVPLLVED

SEQ ID NO: 25977 - protein, 281 aa, Bacillus halodurans
MWENKFQKEGLTFDDVLLVPAKSEVLPRDVSVKTKLTETLQLNIPIISAGMDTVTEAKMAIAIAREGGLGIIHKNMSVEEQAEQVDRVKRSESGVITNPFFLTPDRQVFDAEHLMGKYRISGVPIVDEDQKLVGILTNRDLRFIEDYSTLIDDVMTKENLVTAPVGTTLKEAEEILQKHKIEKLPLVDESGTLKGLITIKDIEKVIEFPNSAKDSQGRLIVGAAVGVSADTDVRVAALVEAGVDVIVIDTAHGHSKGVLEKVKAIREQYPDLTIIAGNVAT

SEQ ID NO: 25978 - protein, 227 aa, Bacillus halodurans
MTSKSKGGRAMSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSS

SEQ ID NO: 25979 - protein, 172 aa, Drosophila melanogaster
MSSSQNNNSSWIDWFLGIKGNQFLCRVPTDYVQDTFNQMGLEYFSEILDVILKPVIDSSSGLLYGDEKKWYGMIHARYIRSERGLIAMHRKYMRGDFGSCPNISCDRQNTLPVGLSAVWGKSTVKIHCPRCKSNFHPKSDTQLDGAMFGPSFPDIFFSLLPNLTSPLDDPRT

SEQ ID NO: 25980 - protein, 477 aa, Homo sapiens
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGNMCLFIAGFAVGWGPIPWLLMSEIFPLHVKGVATGICVLTNWLMAFLVTKEFSSLMEVLRPYGAFWLASAFCIFSVLFTLFCVPEIKGKTLEQITAHFEGR

SEQ ID NO: 25981 - protein, 317 aa, Leishmania major
MSANNNSAAAPKKARQDMPKLGFWEEFMISGVAAGAAKTAAAPIERVKLLVQNQGEMIKQGTLDRPYSGVMNCLTRTVKTEGLYALWRGNLSNVIRYFPTQALNFAFKDQFKRMFNYKKDRDGYMKWFMGNMASGGLAGAVSLCFVYSLDYVRTRLANDTKSAKKGGERQYSGMVDCYIKTFKTDGLVGLYRGFCVSCVGIVAYRGFYFGLYDTLQPMLPVNNFIVNFMLGWVVTIVSGLISYPLDTVRRRMMMTSGTGKNYRNSLECFMQCVKNEGAASLFRGAGANILRGVAGALVLSGVDAIKPYYISARAAKN

SEQ ID NO: 25982 - protein, 477 aa, Mus musculus
MSPEDPQETQPLLRPPEARTPRGRRVFLASFAAALGPLNFGFALGYSSPAIPSLRRTAPPALRLGDNAASWFGAVVTLGAAAGGILGGWLLDRSGRKLSLLLCTVPFVTGFAVITAARDVWMLLGGRLLTGLACGVASLVAPVYISEIAYPAVRGLLGSCVQLMVVTGILLAYVAGWVLEWRWLAVLGCVPPTLMLLLMCYMPETPRFLLTQHQYQEAMAALRFLWGSEEGWEEPPVGAEHQGFQLALLRRPGIYKPLIIGISLMVFQQLSGVNAIMFYANSIFEEAKFKDSSLASVTVGIIQVLFTAVAALIMDRAGRRLLLALSGVIMVFSMSAFGTYFKLTQSLPSNSSHVGLVPIAAEPVDVQVGLAWLAVGSMCLFIAGFAVGWGPIPWLLMSEIFPLHVKGVATGICVLTNWFMAFLVTKEFNSVMEMLRPYGAFWLTAAFCALSVLFTLTVVPETKGRTLEQVTAHFEGR

SEQ ID NO: 25983 - protein, 792 aa, Homo sapiens
MAAPSLLNWRRVSSFTGPVPRARHGHRAVAIRELMIIFGGGNEGIADELHVYNTATNQWFLPAVRGDIPPGCAAHGFVCDGTRILVFGGMVEYGRYSNELYELQASRWLWKKVKPHPPPSGLPPCPRLGHSFSLYGNKCYLFGGLANESEDSNNNVPRYLNDFYELELQHGSGVVGWSIPVTKGVVPSPRESHTAVIYCKKDSGSPKMYVFGGMCGARLDDLWQLDLETMSWSKPETKGTVPLPRSLHTASVIGNKMYIFGGWVPHKGENTETSPHDCEWRCTSSFSYLNLDTTEWTTLVSDSQEDKKNSRPRPRAGHCAVAIGTRLYFWSGRDGYKKALNSQVCCKDLWYLDTEKPPAPSQVQLIKATTNSFHVKWDEVSTVEGYLLQLSTDLPYQAASSDSSAAPNMQGVRMDPHRQGSNNIVPNSINDTINSTKTEQPATKETSMKNKPDFKALTDSNAILYPSLASNASNHNSHVVDMLRKNEGPHTSANVGVLSSCLDVRTVIPETSVSSTVSSTQTMVTQQTIKTESSSTNGAVVKDETSLTTFSTKSEVDETYALPATKISRVETHATATPFSKETPSNPVATVKAGERQWCDVGIFKNNTALVSQFYLLPKGKQSISKVGNADVPDYSLLKKQDLVPGTGYRFRVAAINGCGIGPFSKISEFKTCIPGFPGAPSAVRISKNVEGIHLSWEPPTSPSGNILEYSAYLAIRTAQIQDNPSQLVFMRIYCGLKTSCIVTAGQLANAHIDYTSRPAIVFRISAKNEKGYGPATQVRWLQGNNKKAPLN

SEQ ID NO: 25984 - protein, 447 aa, Coccidioides posadasii
MVMAPSVFEPTDVYITEKYHHESKGSYNSTNHGGPELSHAREASKELILDILQKKAASIDVQNCCPGEEDPFYVADLGEVYRQHIRWKMNLGRVKPFYAVKCNPDPQVLRLMAHLGNGFDCASKAEIDYVLAAGSTPSRIIYAHPCKTKSYLRYAAQQGVNEMTFDNADELYKIKTMCPDRDVFLRILTDDSASLCRLSMKFGASLTVTRSLLELAKDLGLNVVGVSFHVGSGAEDQQHFVKAVEDARFVFDQASDIGHDLKVLDVGGGFCDETFERFAAALSDALDTYFPPHIRVIAEPGRYYVASAFTLAANVIARRDVSPAASDSDSASGPAEMYMIYLNDGCYGNFSNIVFDHQHPVAQILTKDDMDSTHPVEYSIWGPTCDGIDVITKRVTLNREVLGVGNWLYFENMGAYTQCSATRFNGFTDKHDIIYISTEPSAGAMGY

SEQ ID NO: 25985 - protein, 106 aa, Gallus gallus
AAGSVGSVVRRFLAEYGSGTSSRLKVLDAYLLYVMLTGALQFGYCLGVGTFPFNSFLSGFISAVGSFILGVCLRIQINPQNKGEFQGISPERAFADFLFANTILHL

SEQ ID NO: 25986 - protein, 271 aa, Homo sapiens [sequence omitted]

SEQ ID NO: 25987 - protein, 570 aa, Homo sapiens [sequence omitted]

SEQ ID NO: 25988 - protein, 278 aa, Homo sapiens [sequence omitted]

SEQ ID NO: 25989 - protein, 506 aa, Hordeum vulgare subsp. vulgare
MPPRRPNTGGGGGTSSSAAPAPRKVPLRSLLRAASVACGVQFGWALQLSLLTPYVQELGIPHAFASLVWLCGPLSGLLVQPLVGHLSDRITPANSPLGRRRPFIAAGAASIAFAVLTVGFSADLGRLFGDNVVPGSTRIGAIIVYLVGFWLLDVGNNATQGPCRAFLADLTENDPRRTRIANAYFSLFMALGNILGYATGAYNGWYKIFPFTITGSCGVSCANLNSAFLLDIIILAITTYISVATVQDNPTFGSDEAAPPSSHEEEAFLFELFGSFKYFTMPVWMVLIVTSLTWVGWFLFILFDTDWMGREIYRGSPEIVADTQKYHDGVRMGSFGLMLNSVVLGITSIGMEKLCRKWGAGLVWGVSNIIMALCFVAMLIITYVAQNLDYGPSGAPPTGIVAASLIVFTILGAPLSITYSIPYAMAASRVENLGLGQGLAMGILNLSIVIPQIIVSLGSGPWDQLFGGGNAPSFWVAAAASFVGGLVAILGLPRARLGPKKKTTQR

SEQ ID NO: 25990 - protein, 523 aa, Hordeum vulgare subsp. vulgare
MARGGGNGEVELSVGVGGGGGGAAPRAAEPAVQISLGRLILAGMVAGGVQYGWALQLSLLTPYVQTLGLSHALTSFMWLCGPIAGLVVQPCVGLYSDKCTSRWGRRRPFILTGCVLICLAVIIVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLSLALVITLIFAKEVPYKAIAPLPTKANGQVEVEPTGPLAVFKGFKNLPPGMPSVLLVTGLTWLSWFPFILYDTDWMGREIYHGDPKGTPAEANAFQEGVRAGAFGLLLNSVVLGFSSFLIEPMCKRLGPRVVWVSSNMLVCLSMAAICIISWWATQDLHGYIQHAITASKEIKAVSLALFAFLGIPLAILYSVPFAVTAQLAANKGGGQGLCTGVLNIAIVIPQVIIAVGAGPWDELFGKGNIPAFGMASVFALIGGVVGIFLLPKISRRQFRAVSGGGH

SEQ ID NO: 25991 - protein, 167 aa, Citrus unshiu
MASADVEFRCFVGGLAWATTDSSLHEAFSAYGDILESKIINDRETGRSRGFGFVTFRDEKSMRDAIEGMNGQNLDGRNITVNEAQSRGSGGGGGGGYGSRGGGGYGGGGRRESGGGGGYGGSRGYGGGGGGYGGRREGGYSRDGGYGGDGGSRYSRSGASDGGSWRN

SEQ ID NO: 25992 - protein, 591 aa, Cucumis melo
MATKVANQPLFPMPFPAIFFIFSIFFGFGITLSQAASQTRHFKWEVEYMFRSPDCKENLVMGINHQFPGPTIRANVGDTVVVELINKLSTEDVVIHWHGILQKGTPWADGTASISQCAINPGESFTYQFVVDKPGTYFYHGHLGMQRAAGLYGSLIVDLEEGKKEPFHYDEEINLLLSDWWHESVLKQEVGLSSSPMRWIGEPQSILINGRGQSNCSIGAKYMKNMEQCKLSGSEECAPFILKVKPNKTYRIRIISTTSLSALNFAIGNHKLLVVEADGNYVQPFLTSDIDIYSGESYSVLINTDQNPSQNYWVSLGVRGREPKTPPGLTLLNYLPNSFSKLPISPPPETPKWNDYDRSKNFTYRILAAMGSPKPPVKSTRRIFLLNTQNKMNGGYTKWAINNVSLTLPSTPYLGAIKIGINDTFDQNPPPETYPENYDIHKPPPNGNTITGNGVYRFQLGEIVDVVLQNANTLNDKHSEIHPWHLHGHDFWVLGYGEGKFSAAVDETKLNLKDPPLRNTVVIFPFGWTVLRFVADNPGVWAFHCHIEPHLHMGMGVVFAEGVDKVGRIPTHAMACGGTAKALIQNPTQKP

SEQ ID NO: 25993 - protein, 151 aa, Casuarina glauca
ALTEKQEALLKQSWEVLKQNIPAHSLRLFALIIEAAPESKYVFSFLKDSNEIPENNPKLKAHAAVIFKTICESATELRQKGHAVWDNNTLKRLGSIHLKNKITDPHFEVMKGALLGTIKEAIKENWSDEMGQAWTEAYNQLVATIKAEMKE

SEQ ID NO: 25994 - protein, 129 aa, Bos taurus
SGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 25995 - protein, 127 aa, Oncorhynchus mykiss
SGRGKTGGKARAKAKTRSSRAGLQFPVGRVHRLLRKGNYAERVGAGAPVYLAAVLEYLTAEILELAGNAARDNKKTRIIPRHLQLAVRNDEELNKLLGGVTIAQGGVLPNIQAVLLPKKTEKAVKAK

SEQ ID NO: 25996 - protein, 125 aa, Parechinus angulosus
SGRGKGAKAKGKAKSRSSRAGLQFPVGRVHRFLRKGNYANRVGAGAPVYLAAVLEYLAAEILELAGNAARDNKKTRIIPRHLQLAIRNDEELNKLLGGVTIAQGGVLPNIQAVLLPKKTGSKSSK

SEQ ID NO: 25997 - protein, 102 aa, Bos taurus
SGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 25998 - protein, 102 aa, Psammechinus miliaris
SGRGKGGKGLGKGGAKRHRKVLRDNIQGITKPAIRRLARRGGVKRISGLIYEETRGVLKVFLENVIRDAVTYCEHAKRKTVTAMDVVYALKRQGRTLYGFGG

SEQ ID NO: 25999 - protein, 102 aa, Tetrahymena pyriformis
AGGKGGKGMGKVGAKRHSRKSNKASIEGITKPAIRRLARRGGVKRISSFIYDDSRQVLKSFLENVVRDAVTYTEHARRKTVTAMDVVYALKRQGRTLYGFGG

SEQ ID NO: 26000 - protein, 294 aa, Drosophila melanogaster
MQKYDKMEKIGEGTYGTVFKGRNRATMEIVALKRVRLDEDDEGVPSSALREICLLKELKHKNIVRLIDVLHSDKKLTLVFEHCDQDLKKYFDSLNGEIDMAVCRSFMLQLLRGLAFCHSHNVLHRDLKPQNLLINKNGELKLADFGLARAFGIPVKCYSAEVVTLLYRPPDVLFGAKLYTTSIDMWSAGCILAELADAGRPLFPGSDVLDQLMKIFRVLGTPNEDSWPGVSHLSDYVALPSFPAITSWSQLVPRLNSKGRDLLQKLLICRPNQRISAEAAMQHPYFTDSSSSGH

SEQ ID NO: 26001 - protein, 215 aa, Mus musculus
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 26002 - protein, 543 aa, Arabidopsis thaliana
MGGGGNLVDGVRRWLFQRPSSSSSSSSSNNNNNNHEQPIFNSSSFSSSSNPNHSANSGELIIEEDLDFSGLTLINVPKRNHLPMDPHKKGETEFFTEYGEANRYQIQEVVGKGSYGVVASAVDSHTGERVAIKKINDVFEHVSDATRILREIKLLRLLRHPDVVEIKHIMLPPSRREFPHIYVVFELMESDLHQVIKANDDLTPEHYQFFLYQLLRGLKYVHAANVFHRDLKPKNILANADCKLKICDFGLARVSFNDAPTAIFWTDYVATRWYRAPELCGSFFSKYTPAIDIWSVGCIFAEMLLGKPLFPGKNVVHQLDLMTDFLGTPPPESISRIRNEKARRYLSSMRKKQPVPFSHKFPKAEPLALRLLERLLAFDPKDRASAEDALADPYFSGLSNSEREPTTQPISKLEFDFERKKLVKDDVRELLYREILEYHPQMLEEYLRGGDQLSFMYPSGVDRFKRQFAHLEENQGKPVAAGGGRSTALHRHHASLPRERVPAPNGETAEESSDVERRAAAAVASTLESEEQTMEEVTVLVTS

SEQ ID NO: 26003 - protein, 510 aa, Arabidopsis thaliana
MDPHKKVALETEFFTEYGEASRYQIQEVIGKGSYGVVASAIDTHSCEKVAIKKSNDVFEHVSDATRILREIKLLRLLRHPDIVEIKHVMLPPSRRDFRDIYVVFELMESDLHQVIKANDDLTPEHYQFFLYQLLRGLKFIHTANVFHRDLKPKNILANSDCKLKICDFGLARVSFNDAPSAIFWTDYVANRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKLTKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQQGYSARSLLKSASISASKCIGMKPRNKSEYGESNNDTVDALSQKVAALHT

SEQ ID NO: 26004 - protein, 248 aa, Mus musculus
MERASLIQKAKLAEQAERYEDMAAFMKSAVEKGEELSCEERNLLSVAYKNVVVGQRAAWRVLSSIEQKSNEEGSEEKGPEVKEYREKVETELRGVCDTVLGLLDSHLIKGAGDAESRVFYLKMKGDYYRYLAEVATGDDKKRIIDSARSAYQEAMDISKKEMPPTNPIRPGLALNFSVFHYEIANSPEEAISLAKTTFDEAMADLHTLSEDSYKDSTLIMQLLRDNLTLWTADSAGEEGGDWPEEPQS

SEQ ID NO: 26005 - protein, 132 aa, Homo sapiens
MKVKIKCWNGVATWLWVANDENCGICRMAFNGCCPDCKVPGDDCPLVWGQCSHCFHMHCILKWLHAPAGAAALPHVPPGMEVQGVRPTWLSLEGHPETPSSCWRRWLLGTAPLSCNKVETRAGAAFVLPSLC

SEQ ID NO: 26006 - protein, 367 aa, Lentinula edodes
MDDRTTAFIVGSSYQPLDIIGEGAYGVVCSAVHIQSQRKVAIKRITPFDHSMFCLRTLREIKLLRHFQHENIIGILDILKPNLGPDGSLDGMTEVYLVQELMETDLHRVIKTQELSDDHCQYFIYQTLRALKALHSADVLHRDLKPSNLLLNANCDLKLCDFGLARSASPLPDHPVDASTFMTEYVATRWYRAPEVMLTFKQYTKAIDKWSLGCVLAEMLSGKPLFPGRDYHHQLSLILDVLGTPTLDDFYAISSSRSREYIRALPFRKKKVFGKPVHEGGVKGFEGKNPLAIDLMEKCLSFNPKRRIDVEGALAHPYLAPYHDPSDEPGAERIDSEFWSFDTFNNGKGLSKEELKVLIYEEVMRGA

SEQ ID NO: 26007 - protein, 199 aa, Mus musculus
MSWLLGYMDPTEPSFVAAVITIVFNPLFWNVVARWEQRTRKLSRAFGSPHLACYSLGICILLLNILRSHCFTQAMMSQPKMEGLDNHTTYFLGLAFLGWGFVFVLSSFYALGFTGTFLGDYFGILKESRVTTFPFSVLDNPMYWGSTANYLGWALMHASPTGLLLTVVVAIVNVVALLYEEPFTAEIYRQKATRLHKRS

SEQ ID NO: 26008 - protein, 557 aa, Homo sapiens
MSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKGVSMLQDSWSSVISYQKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 26009 - protein, 316 aa, Rattus norvegicus
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLIIQQVFDNGSIYSPEVLDITEQALHTRFLEGVRNVASVCLQIGYPTVASVPHSIINGYKRVLALSVETDYTFPLAEKVKAFLADPSAFAAAAPLAAATTLAPAAAAPAKVEAKEESEESDEDMGFGLFD

SEQ ID NO: 26010 - protein, 321 aa, Trypanosoma cruzi
MPSVSEAKREYEERFNGCLTKYGRVLFCLMDNVRSQQVHDVRRDLRGLGELVMGKKTLQKKIVERRAEDKKASAYDKLLYNTCIEKKLLCGNTALIFTNEEIPVITAVLDKHRVQAPARVGASPCDVIVPAGNTGMEPKATSFFQALNIATKIAKGTVEIVSDKKVLSAGDRVDNSTATLLQKLDISPFYYQVEVQSVWDRGMLFLREDLSITDDVVEKYLLEGISNVVVSLGAGIPTAATLPHMIMDAFKTLLGASVATEYEFDEFDGKNLRKAALEGNLGGGAADAAAATDTGAAAAPAAAAEPEEEDDDDDFGMGALF

SEQ ID NO: 26011 - protein, 225 aa, Rana temporaria
LERSLRDVGMDYLDLFLMHWPVSLKPSGASDPSDKDKPFIYDNVDLCATWEALEARKDAGLVRSLGVSNFNRRQLERILNKPGLKYKPVCNQVECHVYLNQNKLHSYCKSKDIVLVTYSVLGSHRDRNWVDLSLPVLLDDPILNKVAAKYNRTSAEIAMRFILQKGIVVLAKSFTPARIKQNLGVFEFELKPEDMKSLESLDRNLHYGPFREVKQHPEYPFHDEY

SEQ ID NO: 26012 - protein, 198 aa, Oryza sativa (japonica cultivar-group)
GQTPVFPRIFGHEAGGIVESVGEGVTDLAPGDHVLPVFTGECKECADCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGTDLNANRFEEARKFGCTEFVNPKDHDKPVQQ

SEQ ID NO: 26013 - protein, 198 aa, Oryza rufipogon
GQTPVFPRIFGREAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 26014 - protein, 198 aa, Oryza nivara
GQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 26015 - protein, 198 aa, Oryza eichingeri
GQTPVFPRIFGHEAGGIVESVGEGVTDLAPGDHVLPVFTGECKECPHCKSAESNMCDLLRINTDRGVMIGDGKSRFSVNGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 26016 - protein, 198 aa, Oryza punctata
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 26017 - protein, 198 aa, Oryza minuta
GQTPVFPRIFGHEAGGIVESVGEGVTDLAPGDHVLPVFTGECKECPHCKSAESNMCDLLRINTDRGVMIGDGRSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 26018 - protein, 198 aa, Oryza officinalis
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIGLNANRFEEARKFGCTEFVNPKDHDKPVQQ

SEQ ID NO: 26019 - protein, 198 aa, Oryza alta
GQTPMFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 26020 - protein, 198 aa, Oryza latifolia
GQTPMFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVSLAAAEGARIAGASRIIGIDLNANRFEEARKFGCTEFVNPKDHDKPVQQ

SEQ ID NO: 26021 - protein, 198 aa, Oryza australiensis
GQTPMFPRIFGHEAGGIVESVGEGVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 26022 - protein, 198 aa, Oryza ridleyi
GQTPVFPRIFGHEAGGIVESVGDGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 26023 - protein, 198 aa, Oryza longiglumis
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 26024 - protein, 198 aa, Oryza schlechteri
GQTPVFPRIFGHEAGGIVESVGEGVTDLALGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVAKPPKGSTVAIFGLGAVGLAAAEGARIAGASRIIGVDLNANRFEEARKFGCTEFVNPKDHDKPVQQ

SEQ ID NO: 26025 - protein, 198 aa, Porteresia coarctata
GQTPVFPRTFGHEAGGIVESVGEGVTDLTPGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 26026 - protein, 198 aa, Oryza ridleyi
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 26027 - protein, 198 aa, Oryza meyeriana
GQTPMFPRIFGHEAGGIVESVGEGVTDLSPGDHVLPVFTGECKDCPHCKSAESNMCDLLRINTDRGVMIGDGKSRFSINGKPIYHFVGTSTFSEYTVMHVGCVAKINPKAPLDKVCVLSCGISTGLGATINVARPPKGSTVAIFGLGAVGLAAAEGARIAGASRIIGVDLNANRFEEARKFGCTEFVNPKDHDKPVQQ

SEQ ID NO: 26028 - protein, 198 aa, Oryza granulata
GQTPMFPRIFGHEAGGIVESVGEGVTDLSPGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVARPPKGSTVAIFGLGAVGLAAAEGARIAGASRIIGVDLNANRFEEARKFGCTEFVNPKDHDKPVQQ

SEQ ID NO: 26029 - protein, 198 aa, Oryza brachyantha
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARISGASRIIGVDLNPNRFEEARKFGCTEFVNPKDHDKPVQQ

SEQ ID NO: 26030 - protein, 198 aa, Rhynchoryza subulata
GQTPMFPRIFGHEAGGIVESVGEGVTDLAPGDHVLPVFTGECKECPHCKSAESNMCDLLRINTDRGVMIGDGKSRFSINGKPIYHFVGTSTFSEYTVMHIGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 26031 - protein, 198 aa, Leersia perrieri
GQTPVFPRIFGHEAGGIVESVGEGVTDLAPGDHVLPVFTGECKECPHCKSPDSNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNPNRFEEARKFGCTEFINPKDHDKPIQQ

SEQ ID NO: 26032 - protein, 198 aa, Zizaniopsis villanensis
GQTPVFPRIFGHEAGGIVESVGEGVTDLAPGDHVLPVFTGECKECPHCKSPDSNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGVRIAGASRIIGIDLNPNRFEEARKFGCTEFINPKDHDKPIQQ

SEQ ID NO: 26033 - protein, 402 aa, Medicago sativa
MDEAGSSSSLPPFLAKTYEMVDDRSSDPIVSWSASNKSFVVWNPPEFARVLLSEILKHNNFSSFIRQLNTYGFRKVDPEQWEFANDDFIRGQPHLMKNIHRRKPVHSHSLHNLQAQASLTESERQSMIDEIEKLKQDREQLLVETKRYQHDWERHEIQMHCSKDQLEKLEHKQQKMLSSVSEALQKPMIAVNLLPLAEAMERKRRLPARSVCFNNEASVEDAMETSVALPRENSEDNFYFDVKHREIGSTSRHPWHFGKTLAHEVGDNFVHTHSNMDLDESTCCADRLSISCQQLDGEVRPKSPEIDMNVEPAAAALEAVAVKEQPARITTAATGVNDVFWEQFLTEDPGASEAQEVQSERKDNSSRKNEGKPSDHGRFWWNMRKSNNHPEQMGHVSQVEKI

SEQ ID NO: 26034 - protein, 214 aa, Paeonia sinjiangensis
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPNKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 26035 - protein, 214 aa, Paeonia sinjiangensis
IVEGVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPNKGSTVAIFGLGAVGLAAAEGARIAGASRIIGVDLNPERFDEARKFGVTEFVNPKDYNKPAQEVIAEMTGGGVDRSVECTGSIMAMMSAFECVHD

SEQ ID NO: 26036 - protein, 214 aa, Paeonia arietina
IVESVGEGVTDVKPGDHVLPIFTGECKECRHYKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 26037 - protein, 214 aa, Paeonia humilis
IVESVGEGVTDVKPGDHVLPIFTGECKECRHYKSEESNLCDLLRINTDRGVMLNDGKSRFFINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 26038 - protein, 214 aa, Paeonia humilis
IVESVGEGVTDVKPGDHVLPIFTGECKECRHCKSEESNLCDLLRINTDRGVMLNDGKSRFSINGQPIFHFVGTSTFSEYTVLHVGCLAKINTEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 26039 - protein, 214 aa, Paeonia humilis
IVESVGEGVTDVKPGDHVLPIFTGECKECRHYKSEESNLCDLLRINTDRGVMLNDGKSRFSINGQPIFHFVGTSTFSEYTVLHVGCLAKINTEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSIECTGSIMAMMSAFECVHD

SEQ ID NO: 26040 - protein, 214 aa, Paeonia parnassica
IVESVGEGVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTDGGVDRSVECTGSIMAMMSAFECVHD

SEQ ID NO: 26041 - protein, 1096 aa, Entamoeba histolytica
EFGTRLNAQKTGNWRNAITDPKYLADLLKTRDDMDLLNEMVVVFRSSSVSFIKRFVSVGGLANLMAIYKKKIEAENSNTAIDEERKCCEVLRYVFAEEDATVALIRDSGGVELLLKRKNSKRITPDNQLDIFLEITLTSSMVEHPSQEGLYLGGDVCVMNAFSNLVSEGVDMKKFLSFFSLFSKSKSEKFKHASLVLINNLIDQPELEHRMDVRNSFIEIGLVNELENMKNTEWMKIDKIKDSINDFFDSWEEDKKEVESRFDDLKQVVDFESTKSLNNYVTEQMDKFECNDIFTNVHKEILFFAKLKDDNLLLIKKIVILTGIIRQISLQVTKNNNEKSNKKKIESGDNEEERIKIDEVFDRMKLDWEKVTVDQSILEDLNKKKQDLKNSKEQLQITLEKIKTIEKEVSSIDQENSEVNKELNDKKEKIQQIDTESKKINDEIEEVKKKIEQTKKELASKPKGVSVSGTSSLAPPPPPPGASSIPPPPPPPGASSVPPPPPPPGMPGMPGMPGMPPPPPPPGMPGMPPPPPPPGMPGMPPPPPGMPGMPPPPPGMPGMPPPPPGMPGMPPPPPGMPGMPPPPPGMPGMPGMPGMPPPPPGMPGMPPPPPGMPGMPPPPPGGFGFRPAAPVINGLVDTLPKPKSKLKNFMWQKMNDKNLSGTLFTKLDTLDKTKQKLDLSLIEAAFKVPEKLTSSRWQPQKKLKNKDLICILDAKNNQTFYNFALKGLRIKHQKRFVQPLIVLGQTVFGGTSTIKTMFKSSLKMLKEEIGQLKNHIKEKGTDNFRKCRDVCHALNGVSNITLKLNSFQSKMELPVKLEEVGPNIKHVIKASNQLLDSNKFIHLMEVILLMGNFLNSGTAKGNVAGFKFETLNKTLDTKTGDNKRTLLHSIQEYAAEKLKEEVDGWQNEVTEIPLAAKVPGAQFESDIKSLEKMYNDIQTAVGKIPEDGSKFHPIMKKFLEETRGKLDAVAKDFAEMNEIYKKAIQYMALDIAKPPPPEEFFTTLSTFISNWNRVTVKKIKNFRSQRVKKKLKRLKLLLLKRLVKKKTSLAPIPGSQVRVIWLKARRQNPLAMEAAANVGGLKSKLALLLSSKQQKF

SEQ ID NO: 26042 - protein, 414 aa, Euplotes octocarinatus
MEVLNLTPHEKELIKQDVLHKEAELNRKARKKIYPSDFEPLTIIGKGAFGEVRICRHIESGDIVAVKKVVKEMLYKNQVVHVRSERDILVKAKNPWIVALKFSFQDDENLYLVMEYLPGGDLMNLLIKKDILSEEESRFYTAEMILAIESVHNLNYIHRDLKPDNVLLGADGHIKLTDFGLCKHAEIKASQKADTDKYEMKHSENFNALKNILNKRLGYKRDRKLAFSTVGTPDYIAPGVFGTKGYDETVDWWSIGVILFEMLVGYPPFFSDDSTVTCQKILHWKRTLVIPPEANLSAEATDLIEKLICDAEDRLGRNGAQEIKEHPWFEGFDWDNVKEDKAPFIPEVSSPTSAENFDKFKEEAPFFPSSQSKFQKTKMKRKKKDLDFVGYTYKADVEEEKQKFVSALQELDHL

SEQ ID NO: 26043 - protein, 339 aa, Oryctolagus cuniculus
MTDRSPFETDMLTLTRYVMEKGRQAKGTGELTQLLNSMLTAIKAISSAVRKAGLAHLYGIAGTVNVTGDEVKKLDVLSNALVINMLQSSYSTCVLVSEENKEAIITAKERRGKYVVCFDPLDGSSNIDCLASIGTIFAIYRKTTEDEPSDKDALQPGRNIVAAGYALYGSATLVALSTGQGVDLFMLDPALGEFVLVEKDVKIKKKGKIFSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPESIHQRVPLILGSPDDVQEYLACVQKNQAGR

SEQ ID NO: 26044 - protein, 346 aa, Calliphora vicina
MPKVDPETQKLYDEINGLIKKFQDDHKAKADCTMQEKCGDMSDIPKIRLSSKKILKGHINKVNSVHFAGDSRHCVTGSLDGKLIIWDTWTANKVQVIPLRSAWVMTVAFSPSGNFVACGGMDNQCTVYDVNNRDASGVAKMTRELLGYEGFLSSCRFLDDTHLITGSGDMKICHWDLEKGVKTMDFNGHAGDIAGLSLSPDMNTYITGSVDKTAKLWDVREETHKQMFFGHEMDVNSVCYHPSGNGFASASEDQTARLYDIRADQQIALYEPPQKNTGFTSCALSTSGRYLLCSGIEGNIHSFDTMKVCHNGMLQGHENRITCISLSPNGMCLASTSWDQQVRLWL

SEQ ID NO: 26045 - protein, 353 aa, Calliphora vicina
MECCLSEEAKEQKRINQEIERQLRRDKRDARRELKLLLLGTGESGKSTFIKQMRIIHGSGYSDDDKRGYIKLVFQNIFMAMQSMIKAMDMLRISYGARDHAELAELVMSIDYETVTSFEDPYLSAIKTLWADTGIQECYDRRREYQLTDSAKYYLSDLERIEQADYLPSEQDILRARVPTTGILEYPFDLDGIVFRMVDVGGQRSERRKWIHCFENVTSIIFLVALSEYDQILFESDNENRMEESKALFRTIITYPWFQNSSVILFLNKKDLLEEKIMYSHLVDYFPEYDGPKCDHAAAKQFVLKKYLAANPDPERQCYSHFTTATDTENIKLVFCAVKDTIMQNALKEFNLG

SEQ ID NO: 26046 - protein, 435 aa, Trypanosoma brucei brucei
MQQYTLRVAGLADGTADDAVREFFTRFGEVTECVVAGTEATVSYKNQDDYAEALRMDGCEFDVGVTLKVEAVEKTTEDVPQADGAGAGSAEDAAGEVSNGANRDGLSDTGNTEESNKQKRFRDDYKVAVRHLPDDATEQQLRNMFQSAGTILDFFLEPRRRYAFVGFDSREAVEAALKMTGTELNGTIINVELKRTVSRESQLEMKVVVKNLPPDVTENSIRNFFAAVGEPVDIFIHERKMFAFVGFADESACAAAIQMDGTEMDGHRVQIERRQRQRCFKCNKEGHVATQCRGEPTCRTCGRPGHMARDCRMQPGSYDRNRGGNMGAMGRMGHAPPGGYYMGPMGGDRRGDVGRRPPYNDRRVGGEYDRRRPRSRSRSPSYERRHRRRSRSRSRSRTRSRSPKRFTRERERGRDRSRSPSRRRYPREGERPRRA

SEQ ID NO: 26047 - protein, 394 aa, Bos taurus
MGCLGNSKTEDQRNEEKGQREANKKIEKQLQKDKQVYRATHRLLLLGAGESGKSTIVKQMRILHVNGFNGEGGEEDPQAARSNSSGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQDDYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHSTCAVDTENIRRVFNDCRDIIQRMHLRQYELL

SEQ ID NO: 26048 - protein, 197 aa, Oryza sativa
GQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVH

SEQ ID NO: 26049 - protein, 197 aa, Oryza rufipogon
GQTPVFPRILGHEAGGIVESVGEDVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVH

SEQ ID NO: 26050 - protein, 197 aa, Oryza nivara
GQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCIFSCGFSTGFGATVNVAKPKKGQTVAIFGLGAVGLAAMEGARLSGASRIIGVDLNPAKFEQAKKFGCTDFVNPKDHSKPVH

SEQ ID NO: 26051 - protein, 197 aa, Oryza eichingeri
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 26052 - protein, 197 aa, Oryza punctata
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAALEGARLSGASRIIGVDLNPAKFEQAKKFGCTDFVNPKDHSKPVH

SEQ ID NO: 26053 - protein, 197 aa, Oryza minuta
GQTPVFPRILGHEAGGIVESVGEGVTELAPGDHVLPVLTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 26054 - protein, 197 aa, Oryza officinalis
GQTPVFPRILGHEAGGIVESVGEGVTELAPGDHVLPVFTGECKECAHCKSEESNMCDLLRINVDRGVMIGDGQSRFTIKGKPIFHFVGTSTFSEYTVIHVGCLAKINPEAPLDKVCILSCGISTGLGATVNVAKPKKGQTVAIFGLGAVGLAAMEGARLSGASRIIGVDLNPAKFEQAKKFGCTDFVNPKDHSKPVH

SEQ ID NO: 26055 - protein, 197 aa, Oryza rhizomatis
GQTPVFPRILGHEAGGIVESVGEGVTELAPGDHVLPVFTGECKECAHCKSEESNMCDLLRINVDRGVMIGDGQSRFTIKGKPIFHFVGTSTFSEYTVIHVGCLAKINPEAPLDKVCILSCGIFTGLGATLNVAKPKKGQTVAIFGLGAVGLAAMEGARLSGASRIIGVDLNPAKFEQAKKFGCTDFVNPKDHSKPVH

SEQ ID NO: 26056 - protein, 197 aa, Oryza eichingeri
GQTPVFPRILGHEAGGIVESVGEGVTELAPGDHVLPVFTGECKECAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 26057 - protein, 197 aa, Oryza latifolia
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGRLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 26058 - protein, 197 aa, Oryza grandiglumis
GQTPVFPRILGHEAGGIVESVGEGVTELAPGDHVLPVFTGECKECAHCKSEESNMCDLLRINVDRGVMIGDGQSRFTINGKPIFHFVGTSTFGEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 26059 - protein, 197 aa, Oryza australiensis
GQTPVFPRILGHEAGGIVESVGEGVTELTPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 26060 - protein, 197 aa, Oryza ridleyi
GQTPVFPRILGHEAGGIVESVGEGVTELVPGDHVLPVFTGECKDCAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVQ

SEQ ID NO: 26061 - protein, 197 aa, Porteresia coarctata
GQTPVFPRILGHEAGGIVESVGEGVKELVPGDHVLPVFTGECKDCAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVQ

SEQ ID NO: 26062 - protein, 197 aa, Porteresia coarctata
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHKKPVQ

SEQ ID NO: 26063 - protein, 197 aa, Oryza schlechteri
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHKNPVQ

SEQ ID NO: 26064 - protein, 197 aa, Oryza meyeriana
GQTPVFPRILGHEAGGIVESVGEGVTELVPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLPGASRIIGVDLNPAKYEQAKKFGCTDFVNPKDHSKPVQ

SEQ ID NO: 26065 - protein, 197 aa, Oryza granulata
GQTPVFPRILGHEAGGIVESVGEGVTELVPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLFGASRIIGVDLNPAKYEQAKKFGCTDFVNPKDHSKPVQ

SEQ ID NO: 26066 - protein, 197 aa, Oryza brachyantha
GQTPVFPRILGHEAGGIVESVGEGVTELAPGDHVLPVFTGECKECAHCKSEESNMCDLLRINVDRGVMIGDGQSRFTIGGKPIFHFVGTSTFSEYTVIHVGCLAKINPEAPLDKVCILSCGISTGLGATVNVAKPKKGQTVAIFGLGAVGLAAMEGARLSGASRIIGVDLNPAKFEQAKKFGCTDFVNPRDHKKPVQ

SEQ ID NO: 26067 - protein, 197 aa, Rhynchoryza subulata
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCVLSCGISTGLGATLNVAKPTKGSTVAIFGLGAVGLSAMEGARLSGASRIIGVDLNPAKYEQAKKFGCTDFVNPKDYNKPVQ

SEQ ID NO: 26068 - protein, 197 aa, Leersia perrieri
GQTPVFPRILGHEAGGIVESVGEGVTELAPGDHVLPVFTGECKECAHCKSEESNMCDLLRINVDRGVMIGDGKSRFTINGKPIFHFVGTSTFSEYTVIHVGCLAKINPEAPLDKVCILSCGISTGLGATLNVAKPKKGSTVAIFGLGAVGLAAMEGARLSGASRIIGVDLNPAKYEQAKKFGCTDFVNPKDHKKPVQ

SEQ ID NO: 26069 - protein, 197 aa, Zizaniopsis villanensis
GQTPVFPRILGHEAGGIVESVGEGVTELAPGDHVLPVFTGECRECAHCKSEESNMCDLLRINVDRGVMIGDGKSRFTINGKPIFHFVGTSTFSEYTVIHVGCLAKINPEAPLDKVCILSCGISTGLGATLNVAKPKKGSTVAIFGLGAVGLAAMEGARLSGASRIIGVDLNPAKYGQAKKFGCTDFVNPKDHKKPVQ

SEQ ID NO: 26070 - protein, 377 aa, Mus musculus
MAARGAAGLRGGGEKAQREANKKIEKQLQKDKQVYRATHRLLLLGAGESGKSTIVKQMRILHVNGFNGDEKATKVQDIKNNLKEAIETIVAAMSNLVPPVELANPENQFRVDYILSVMNLPNFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 26071 - protein, 355 aa, Drosophila melanogaster
MGCAVSTARDKEAIERSKNIDRALRAEGERAASEVKLLLLGAGESGKSTIVKQMKIIHDTGYSQEECEEYRRVVFSNTVQSLMVIIRAMGRLKIEFADPSRTDIARQFFTHASAADEGILLPEIVLLMKKLWADGGVQQTFARSREYQLNDSAGYYLNSLDRIAQPNYIPTQQDVLRTRVKTTGIIETHFSCKQLHFKLFDVGGQRSERKKWIHCFEGVTAIIFCVALSGYDLVLAEDEEMNRMIESLKLFDSICNSKWFVETSIILFLNKKDLFEEKIKRSPLTICFPEYTGTNTFEEAANYIRMKFENLNKRKDQKEIYTHLTCATDTNNVKFVFDAVTDVIIKNNLKQIGLF

SEQ ID NO: 26072 - protein, 354 aa, Bos taurus
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSPELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGSNTYEDAAAYIQAQFESKNRSPNKEIYCHMTCATDTNNIQVVFDAVTDIIIANNLRGCGLY

SEQ ID NO: 26073 - protein, 354 aa, Xenopus laevis
MGCTLSAEERAAVERSKQIEKNLKEDGVTAAKDVKLLLLGAGESGKSTIVKEMKIIHEDGFSGEDVKQYKPVVYSNTIQSLRAIVRAMDTLGIEYGDKERRADAKMVCDVVSRMEDTEPYSPEVVSAMVRLWADSGIQECFNRSREYQLNDSAKYYLDSLDRIGAPDYQPTEQDILRTRVKTTGIVETHFTFKNLHSRLFDVGGQRSERKKWWHCFEDVTAIIFCVALTGYDQVLHEDETTNRMHESLKLFDSICNNKWFTDTSIILFLNKKDIFQEKIKSSPLTICFPEYTGPNSFTEAVAHTQHQYESRNKSENKEIYTHITCATDTQNIQFVFDAVTDVIIAYNLRGCGLY

SEQ ID NO: 26074 - protein, 354 aa, Drosophila melanogaster
MGCAQSAEERAAAARSRLIERNLKEDGIQAAKDIKLLLLGAGESGKSTIVKQMKIIHESGFTAEDFKQYRPVVYSNTIQSLVAILRAIPTLSIQYSNNERESDAKMVFDVCQRMHDTEPFSEELLAAMKRLWQDAGVQECFSRSNEYQLNDSAKYFLDDLDRLGAKDYQPTEQDILRTRVKTTGIVEVHFSFKNLNFKLFDVGGQRSERKKWIHCFEDVTAIIFCVAMSEYDQVLHEDETTNRMQESLKLFDSICNNKWFTDTSIILFLNKKDLFEEKIRKSPLTICFPEYTGGQEYGEAAAYIQAQFEAKNKSTSKEIYCHMTCATDTNNIQFVFDAVTDVIIANNLRGCGLY

SEQ ID NO: 26075 - protein, 176 aa, Dictyostelium discoideum
VVTKSSPWKPPLHYQTIFVTTTGCRDIVRGEHFAVMKEDAIVCNIGHFDCEIDVAWLNGNAKKDTVKPQVSRYTLANGVHIILLAEGRLVNLGCGTGHPSFVMSNSSVTKLAQIALWTKTEEYPLGVHFLPKILDEEVARLHLDQLGAKLTTLTEKQSEYLSVPVAGPYKVDHYRY

SEQ ID NO: 26076 - protein, 386 aa, Citrus sinensis
WIPRAAGIRLRVPLLHLSNFQINDWPELSTKRYALMVLMLPSDSARQWHVHELELVEVVADQVAVALSHAAILEESMRARDLLMQQNIALDSARREAETAIRARNDFLAVMNHEMRTPMHAIIALSSLLQETELTPEQRLMVETILKSSNLLATLINDVLDLSRLEDGSLQLQIGTFNLHAVFREVLNLIKPIASVKKLLVALNLAPDLPEYAVGDEKRLMQTLLNVVGNAVKFTKEGNISITGFVAKSESLRDSRAPEFFPVPIENHFYLRVQVRDSGSGISPQDIPNLFTKFAQNQAIALRNSSGSGLGLAICKRFVNLMEGHIWIESEGLGKGCTAIFIVKLGIPEHSNDSNLSFIPKMPVHGQTNFPGLKVLVMDENGVSRQ

SEQ ID NO: 26077 - protein, 393 aa, Hemicentrotus pulcherrimus
MASMSRARVYADVNSHRPREYWDYESHVVEWGQQDDYQIVRKLGRGKYSEVFEAVNITSNEKCVIKILKPVKKKKIKREIKILENLRGGPNIIALQAIVKDPVSRTPALIFEYVNNTDFKQLYQTLKDYEIRYYLFELLKALDYSHSMGIMHRDVKPHNVMIDHENRRLRLIDWGLAEFYHPGQEYNVRVASRYFKGPELLVDYQLYDYSLDMWSLGCMLASMIFRKEPFFHGHDNYDQLVRIAKVLGTDELYEYLDKYQIELDPRFNDILGRHSRKRWERFVHSENQHLVSPEALDFLDKLLRYDHQERVTAREAMEHPYFYPVVKEQNRSMPPVMSTQPNTSTSATNSSSASIDTKARPSGTIPGAPLIPTPTAQTVSPIPNPSPAAAVAP

SEQ ID NO: 26078 - protein, 1046 aa, Homo sapiens
NSDTSLDAKVLGSKDATSSKQQMRATPKFGPYQKALREIRYSLLPFANESGTSAAAEVNRQMLQELVNAGCDQEMAGRALKQTGSRSIEAALEYISKMGYLDPRNEQIVRVIKQTSPGKGLMPTPVTRRPSFEGTGDSFASYHQLSGTPYEGPSFGADGPTALEEMPRPYVDYLFPGVGPHGPGHQHQHPPKGYGASVEAAGAHFPLQGAHYGRPHLLVPGEPLGYGVQRSPSFQSKTPPETGGYASLPTKGQGGPPGAGLAFPPPAAGLYVPHPHHKQAGPVAHQLHVLGSRSQVFASDSPPQSLLTPSRNSLNVDLYELSSTSVQQWPAATLARRDSLQKPGLEAPPRAHVAFRPDCPVPSRTNSFNSHQPRPGPPGKAEPSLPAPNTVTAVSAAHILHPVKSVRVLRPEPQTAVGPSHPAWVPAPAPAPAPAPAPAAEGLDAKEEHALALGGAGAFPLDVEYGGPDRSARLRPTRSTCCCAKSEQYDLDSLCAGMEQSLRAGPNEPEGGDKSRKSAKGDKGGKDKKQIQTSPVPVRKNSRDEEKRESRIKSYSPYAFKFFMEQHVENVIKTYQQKVNRRLQLEQEMAKAGLCEAEQEQMRKILYQKESNYNRLKRAKMDKSMFVKIKTLGIGAFGEVCLACKVDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGSHVRQDSMEPSDLWDDVSNCRCGDRLKTLEQRARKQHQRSLAHSLVGTPNYIAPEVLLRKGYTQLCDWWSVGVILFEMLVGQPPFLAPTPTETQLKVINWENTLHIPAQVKLSPEARDLITKLCCSADHRLGRNGADDLKAHPFFSAIDFSSDIRKQPAPYVPTISHPMDTSNFDPVDEESPWNDASEGSTKAWDTLTSPNNKHPEHAFYEFTFRRFFDDNGYPFRCPKPSGAEASQAESSDLESSDLVDQTEGCQPVYV

SEQ ID NO: 26079 - protein, 495 aa, Mus musculus
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDESAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTAAVPAPQPPVTKPLFPSAGQMGTPVTSSSTASSNSESLSASSKALFPSTAQAQAAVQGPVGTDFKPLNSTPAATTTEPPKPTFPAYTQSTASTTSTTNSTAAKPAASITSKPATLTTTSATSKLIHPDEDISLEERRAQLPKYQRNLPRPGQTPIGNPPVGPIGGMMPPQPGLPQQQAMRPPMPPHGQYGGHHQGMPGYLPGAMPPYGQGPPMVPPYQGGPPRPPMGMRPPVMSQGGRY

SEQ ID NO: 26080 - protein, 598 aa, Haemophilus influenzae Rd
MKNFKYFAQSYVDWVIRLGRLRFSLLGVMILAVLALCTQILFSLFIVHQISWVDIFRSVTFGLLTAPFVIYFFTLLVEKLEHSRLDLSSSVNRLENEVAERIAAQKKLSQALEKLEKNSRDKSTLLATISHEFRTPLNGIVGLSQILLDDELDDLQRNYLKTINISAVSLGYIFSDIIDLEKIDASRIELNRQPTDFPALLNDIYNFASFLAKEKNLIFSLELEPNLPNWLNLDRVRLSQILWNLISNAVKFTDQGNIILKIMRNQDCYHFIVKDTGMGISPEEQKHIFEMYYQVKESRQQSAGSGIGLAISKNLAQLMEGDLTVESERGKGATFHLTLHAQEISEKESVKKNIPSLNTLLVEDVDLNIMVAKTILEKLGHHVDVATNGKQAITLFEKNVYDILLLDIKLPDMSGFEIAQYLRENYENGIYDFLPPMIAFTANVMQSEQEYLEMGMDGVLRKPISIKDLHHCLQQFFADESESIIEMNDDNELSEQFDLALIETLGKSQILENLSLFKQTMPNYLAQLSKDNMKETEDTAHKIKGAAASVGLNHLRQLADTLESAAKNSDVFNCGELIDKIGNLWLEDVEDLLKFCKF

SEQ ID NO: 26081 - protein, 412 aa, Petunia x hybrida
MDPEAFSASLFKWDPRGAMPPPNRLLEAVAPPQPPPPPLPPPQPLPPAYSIRTRELGGLEEMFQAYGIRYYTAAKITELGFTVNTLLDMKDDELDDMMNSLSQIFRWELLVGERYGIKAAIRAERRRLEEEEGRRRHILSDGGTNVLDALSQEGLSEEPVQQQEREAAGSGGGGTAWEVVAPGGGRMRQRRRKKVVVGRERRGSSMEEDEDTEEGQEDNEDYNINNEGGGGISERQREHPFIVTEPGEVARGKKNGLDYLFHLYEQCRDFLIQVQNIAKERGEKCPTKVTNQVFRFAKKAGASYINKPKMRHYVHCYALHCLDEDASNALRRAFKERGENVGAWRQACYKPLVAIAARQGWDIDAIFNGHPRLSIWYVPTKLRQLCHSERSNAAAAASTSVSGGGVDHLPHF

SEQ ID NO: 26082 - protein, 389 aa, Oryza sativa; identical to SEQ ID NO: 770

SEQ ID NO: 26083 - protein, 411 aa, Pinus radiata
MDPESFSAAFFKWDQRPPALAPPQMQRSAGLEAQRIFHDFGVPNAAAMAASNNSSSCRKELNCLEELFRNYGVRYITLTKMVDMGFTVNTLVNMTEQELDDLVRTLVEIYRVELLVGEKYGIKSAIRAEKRRLEEAERKRMEQLFVDVDGKRKIDENALDTLSQEGLSVEEPQGDNAIILSQNNTSANFPLNLNAGMDPVLILQNSGHLGTTVSGLIGMPDTNYGSEQTKACKKQKRRRSKDSGEDGEERQREHPFIVTEPGELARGKKNGLDYLFDLYEQCGKFLLDVQHIAKERGEKCPTKVTNQVFRHAKHSGAGYINKPKMRHYVHCYALHCLDIEQSNRLRRAYKERGENVGAWRQACYYPLVAMAKDNGWDIEGVFNKHEKLRIWYVPTKLRQLCHLEKSKQSHL

SEQ ID NO: 26084 - protein, 359 aa, Eucalyptus globulus
MDPEAFAVVGLRTMGGLEELFEAYGIRYLTASRIAEMGFTANTLLDMKEEELDDMMNSLSHIFRWDLLVGERYGIKAAIRAERRRLLEADDRRHHLHSTDHALLDALSHQGLSEEQVVQHSEKDQLGRAGSGDTAGTSWGAQQQRKKHRHRHHITAMKGAATEEDEEDEEEVEEMRRQREHPFIVTEPGEVARGKKNGLDYLFHLYDQCRDFLLQVQSLAKERGEKCPTKVTNQVFRYAKKAGASYINKPKMRHYVHCYALHCLDEHASNALRKSFKERGENVGAWRQACYHPLVTIAGRRAGWDIDAIFNAHPRLCIWYVPTKLRQLCHAHRHSSASAASSASTSTSAPTAHHLELPY

SEQ ID NO: 26085 - protein, 413 aa, Nicotiana tabacum
MDPEAFSASLFKWDPRGAMPPPTRLLEAAVAPPPPPPVLPPPQPLSAAYSIRTRELGGLEELFQAYGIRYYTAAKIAELGFTVNTLLDMKDEELDDMMNSLSQIFRWELLVGERYGIKAAIRAERRRLEEEELRRRSHLLSDGGTNALDALSQEGLSEEPVQQQEREAVGSGGGGTTWEVVAAVGGGRMKQRRRKKVVSTGRERRGRASAEEDEETEEGQEDEWNINDAGGGISERQREHPFIVTEPGEVARGKKNGLDYLFHLYEQCRDFLIQVQNIAKERGEKCPTKVTNQVFRYAKKAGASYINKPKMRHYVHCYALHCLDEEASNALRRAFKERGENVGAWRQACYKPLVAIAARQGWDIDTIFNAHPRLAIWYVPTRLRQLCHSERSNAAAAASSSVSGGVGDHLPHF

SEQ ID NO: 26086 - protein, 416 aa, Nicotiana tabacum
MDPEAFSASLFKWDPRGAMPPPTRLLEAAVAPPPPPPALPPPQPLSAAYSIKTRELGGLEELFQAYGIRYYTAAKIAELGFTVNTLLDMKDEELDDMMNSLSQIFRWELLVGERYGIKAAIRAERRRLEEEELRRRGHLLSDGGTNALDALSQEGLSEEPVQQQEREAVGSGGGGTTWEVVAAAGGGRMKQRRRKKVVAAGREKRGGASAEEDEETEEGQEDDWNINDASGGISERQREHPFIVTEPGEVARGKKNGLDYLFHLYEQCRDFLIQVQNIAKERGEKCPTKVTNQVFRYAKKAGASYINKPKMRHYVHCYALHCLDEEASNALRRAFKERGENVGAWRQACYKPLVAIAARQGWDIDTIFNAHPRLAIWYVPTKLRQLCHSERSNAAAAAASSSVSGGGGGGDHLPHF

SEQ ID NO: 26087 - protein, 377 aa, Populus balsamifera subsp. trichocarpa
MDPEAFTASLFKWDTRAMVPHPNRLLEMVPPPQQPPAAAFAVRPRELCGLEELFQAYGIRYYTAAKIAELGFTVNTLLDMKDEELDEMMNSLSQIFRWDLLVGERYGIKAAVRAERRRLDEEDPRRRQLLSGDNNTNTLDALSQEGFSEEPVQQDKEAAGSGGRGTWEAVAAGERKKQSGRKKGQRKVVDLDGDDEHGGAICERQREHPFIVTEPGEVARGKKNGLDYLFHLYEQCRDFLIQVQSIAKERGEKCPTKVTNQVFRYAKKAGASYINKPKMRHYVHCYALHCLDEDASNALRRAFKERGENVGAWRQACYKPLVAIASRQGWDIDSIFNAHPRLAIWYVPTKLRQLCYAERNSATSSSSVSGTGGHLPF

SEQ ID NO: 26088 - protein, 404 aa, Pinus radiata
MDAEHFPVGFFRWDQRPAPVVAAAAAPTTTVFNKDHGRPLEVILPMNGRKDLKSLEDLFKEYGVRYVTLAKMTEMGFTANTLVNMTEEEIEDLMKTLVELYHMDLLIGERYGIKSAIRAEKKRLQDSLEMQRLEILSEAERKRILHDDQNTFAAAMASEGTSKELRANDPLIFPESTSADHAPMNIASCKDSTLILQNSNQAQFCGSGLIGVPEHSSESDERKADTNKQKRRRSKEPGEDGEDRPREHPFIVTEPGELARGKKNGLDYLFDLYEQCGKFLLEVQRIAKEKGEKCPTKVTNQVFRHAKHNGAVYINKPKMRHYVHCYALHCLDSEQSNHLRRLYKERGENVGAWRQACYYPLVAIARENNWDIEGIFNRNEKLKIWYVPTKLRQLCHMERSKECQ

SEQ ID NO: 26089 - protein, 395 aa, Pisum sativum
MDPDAFTASLFKWDPRTVLSTAPSPRPQLLDYAVTPTTAPMTYHPARLPRELGGLEELFQAYGIRYYTAAKIAELGFTVSTLVDMKDDELDDMMNSLSQIFRWDLLVGERYGIKAAIRAERRRLDEEEIKRRGLLSGDTTNALDALSQEGLSEEPVVQREKEAMGSGGGSTWEVAVVEERRKRQQIRRRRMKMKGNDHGENEEGEEEEEDNISGGGVGGGERQREHPFIVTEPAEVARGKKNGLDYLFHLYEQCREFLIQVQAIAKERGEKCPTKVTNQVFRYAKKAGASYINKPKMRHYVHCYALHCLDEEVSNELRRGFKERGENVGAWRQACYKPLVAIAARQGWDIDAIFNAHPRLSIWYGPTKLRQLCHAERNGAAASSSVSFGTTHLPF

SEQ ID NO: 26090 - protein, 489 aa, Halomonas elongata
MTAQSAQPLYIGGRPVDATSGETFTVTNPYDGSLLATIGQASQADVDSAVQAAQRGQREWAAMTGMERSRILLRAVALLRERNDELAELETRNTGKPISETASVDIVTGADALEYYAGLAPAIEGSQIPLRDTRLVYTRREPLGVIGAIGAWNYPIQIACWKAAPALAAGNAIVFKPSEVTPLTALKLAEIFTEAGLPDGVFNVVQGDGRVGAMLTEHEGIAKVSFTGEVGTGKKVMAAAGGSTLKDVTMELGGKSPLIVFADADLDRAADAAMMANFYSSGQICTNGTRVFVERSAKEAFEAKLVERVARIKAGDPMDPSVNFGPLVSFEHQEKVLSYIALGKEQGARVLAGGDAWNSGEWAKGAWAAPTVFTDCTDEMRVVKEEIFGPVMSVLAFDDEEEVIRRANNTKYGLAAGVFSESLNRAHRVIHQLEAGICWINTWGESPSEMPVGGYKESGIGRENGVETLNHYTQTKSVQIEMGPFESVF

SEQ ID NO: 26091 - protein, 931 aa, Homo sapiens
KAISRAGLQHLAPAHPLSLPVANGPPKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 26092 - protein, 496 aa, Mus musculus
MDRMKKIKRQLSMTLRGGRGIDKTNGVPEQIGLDESGGGGGSDLGEAPTRIAPGELRSVRGPLSSAPEIVHEDMKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNVINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFRTYNYPKYRAEALLSHAPRLDSDGADLLTKLLQFEGRNRISAEDARKHPFFLSLGERIHKLPDTTSIFALKEVQLQKEANIRSTSMPDSGRPAFRVVDTEF

SEQ ID NO: 26093 - protein, 355 aa, Pisum sativum
MADQDNSTRRPQREAKKRAVAALCEQRKRKRVALGDITNDVVSETEKLVSDSHSHTQKKKKRNIAKSPVPEKLEDPQLCEPYVSDIHDYLRNLEVDPSKRPLPDYIQKVQRDINANMRGVLVDWLVEVAEEYKLVADTLYFSVSYIDRFLSLNDLSRQKLQLLGVSSMLIASKYEEIKPPEVEDFCYITDNTYSKEEVLSMEAEILKTLKFELGGPTIKTFLRRFITKVGQEGVDASELQFEFLCCYLAELSLLDYNCVKFLPSMVAASVVFLARFMLNPKSRPWNSAICQFTSYKPADLKECVLNMHDLYLGRKGATLQAVRDKYKQHKFKCVATTPSPPEISLSFFEFRGADP

SEQ ID NO: 26094 - protein, 420 aa, Oryza sativa (japonica cultivar-group)
MNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAPDCMMGSRVEISKSMNPEAFASAHSTPIQPIGRNETVLKFGPEVPLCESMASVLNIQEQNGTNAAAVPTGENQEDNSCISSITSHNVLPENAAQVDKNSTPVYCNGVGPVPQYYLGAPYMYPWNIGWNNVPMMVPGTSMPESASQSESCSTSSAPWMNMNSPMMPVASRLSAPPFPYPLVPPALWGCLSSWPATAWNIPWIRTNGGCMSPSSSSNSSCSGNGSPLGKHSRDSSLPLKEDKEEKSLWVPKTLRIDDPDEAAKSSIWATLGIKPGDPGIFKPFQSKGESKGQAASETRPARALKANPAALSRSQSFQETS

SEQ ID NO: 26095 - protein, 473 aa, Oryza sativa (japonica cultivar-group)
MAHAVESMEKLRAAVDEDKDSFMHLVSRYLIREEKEMIDWNKVERPTPEMVVPYDSLVQAPRDIPEIRNLLNKLAVLKLNGGLGTTMECVAPKCTIEVRSGLTFLDLAIMQTEFLNKKYGCSVPILLMNSFNTSLVNKIVEKYTNIEIHTFNQNKYPRIITEKFLPLSSEGSTGSHCWYPPGHGDVFFSLCKSGILDTMLSQYNILINVSWLASEIESLTSTEILNHLIHNKNEYCMEVTPKTSADVKGGSLICYEGLSCNVKFVANHHVDEFQSIENFNMLNTNNLRVNLKAIKRLVKAEALKMEIIPNLKEVDGVKVLQLEKEAGSAIQCFEKAIGVTVPRSRFLAVKNTSDLFLILSDLYIVMDGTVTRNPARDNSTNPLIDLGPEFRKVDSFLDRFKSIPSIVALDSLKISGDVWFGSRITLKGEVTIAAQLGLKLDILDGSVFDNKVKVHLWIIICFVVILETVLLFQ

SEQ ID NO: 26096 - protein, 651 aa, Homo sapiens
EHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 26097 - protein, 142 aa, Oryza sativa (japonica cultivar-group)
MAAAEEKKKKKMIKVMSSDGETFEMTEAAASMTAAPTAAPASLSKIIEYCTKHAAVEGRSTAAAELKRFDEELIDVDTDTLYHLLMAGNLMGVEGVLELAVQRTAELIRGKSPEEIRDTFKIANDFTPEEEEIIKENAWALQ

SEQ ID NO: 26098 - protein, 166 aa, Oryza sativa (japonica cultivar-group)
MAAAAEEKNKKMIKVISSDGEAFEMTEAAASMSRILLHMIEDGCTGDGGAGITLPNVAGSALAKVIEYCTKHAIAAAEGSSSSRKAKEELKKFDVEFMEVGIDMLYDLIMAANFMGVEGLLSLAAQRTAELIKGKSPEQIREMFGIKNDHTPEEEEQIRKEYEWAF

SEQ ID NO: 26099 - protein, 305 aa, Yarrowia lipolytica
MSDKSNFLVDFLMGGVSAAVSKTAAAPIERVKLLIQNQEEMIKQGRLSRPYKGIIDCFKRTAADEGIASFWRGNTANVIRYFPTQALNFAFKDKFKKMFGFKKSEGYWWWMAGNLASGGLAGATSLAFVYSLDYARTRLANDAKSVAKDGKAAGERQYNGLIDVYRKTIASDGIAGLYRGFGVSVVGIIVYRGLYFGLYDSLKPVVLVGPLEGNFLASFLLGWTVTTGASTASYPLDTVRRRMMMTSGTGVKYSSSMACMASIIKNEGVGALFKGCGANILRGVAGALVISMYDQMQMIMFGKKF

SEQ ID NO: 26100 - protein, 380 aa, Vitis vinifera
MSSTAGQVIRCKAAVAWEAGKPLVIEEVEVAPPQVMEVRLKILVTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 26101 - protein, 363 aa, Vitis vinifera
MGVPQVLATFLALGELTNFLRLGFLRYWQRHGFCSLILLQHSLDGGVDDVIAPTQELSSVGLHVTATVMCASARSSTSTAQTAIYDTFIFALTDMVETERERERETRAEFGTSSCRIRHEGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 26102 - protein, 262 aa, Oryza sativa; identical to SEQ ID NO: 3187

SEQ ID NO: 26103 - protein, 460 aa, Pyrococcus woesei
MNIKKLTPLLTLLLFFIVLASPVSAAKYLELEEGGVIMQAFYWDVPRGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 26104 - protein, 498 aa, Lycopersicon esculentum
MAKKNFVLHYNLLLISLLAFLFLLTEGAPQSALVTQLPGFNGTFNSKHYAGYVNIDESHGKNLYYYFVESERNPSKDPVVLWLNGGPGCSSFDGFVYEHGPFNFDFGKPSGSLPSLHNNPYSWSKVSNIIYLDSPVGVGLSYSGNKSDYNTGDLKTASDSHSFLLKWFEIYPEFLKNPFYISGESYAGIYVPTLASEVIKGIDAGVRPAINFMGYMVGNGVADDIIDGNAIVPFQHGMGLISDDLYEEAVVACHGNFYEPVDSNCSEKLNKIDQVVYDLNVYDILEPCYHSKKPSVITTGNSRLPMSFRKLGETERPLPVRKRMFGRAWPYKAPVRAGHVPTWPEILNSVEVPCTDDRVATLWLNNADVRKAIHAEPATVIGPWELCTDKIDLDHDSGSMIPYHKNLTARGYRAIIFSGDHDMCVPFTGSAVWTKSLGYPIVDEWRPWYVNDQVAGFIQGYANNLIFMTIKGAGHTVPEYKPREALAFYSRWLEGKKI

SEQ ID NO: 26105 - protein, 597 aa, Caulobacter vibrioides
MILPTALKSRLALEFETLPDPFRRPAARAAGLDPAHAWRLGWLAAVCLAAAAALFTADSGGWPVWAALGAGALPALVSLIFTREDERTQSWLLVLWAVGGSLAAVLTGGVGGAMAAWCLAPVAAASTQDQPKRLAEGAALALIGACVAALTQLSGLAPAAPTGPLAFVLGFLALVTTGLGLAAGLLIGRRRQGARDDRYASEIIGLETLLDGLPHLAIAVRGQGQVTAVRGAAPPGVTRADLVNRGLTGAAAPGDRQRLTAAIAQAHREGSASLTFNPALGVERVVALDMHRVAPNQLVGVLRDITVERHREHALDQARIDAEALAAGRARFLANMSHELRTPLNAIMGFSDIMRARMFGPLSDRYAEYAELIHESGGHLLDLINDVLDMSKIEAERFELQRGVFDAREAVQAAMRLLRVQSDTAGVQLRGVLPPGELEVDADRRALKQIVLNLVSNALKFTPRGGQVTVTAHGYDGVLEIVVADTGVGISPEDLERLGRPYEQAGGAEQRARGTGLGLSLVRAFAQLLGGEMVIESRLGAGTTVSVRLPVLLAPMVAATPTPPAAPEAPSAPEPAPTVEEPPPASLGDNVIAFAPR

SEQ ID NO: 26106 - protein, 307 aa, Paramecium tetraurelia
MKSNKLEKYEKKEKLGEGTYIVYKALDRNTNEYVAIKKIRLESEEEGIPSTAIREISLLKELNHPNIVKLMEVVHSNKKLVLVFEYFEMDLKKFLAQFPKEKGMEPVIVKSFLYQLLRGIQACHQQKILHRDLKPQNLLGSKDGILKLADFGLARASGIPVKSFTHEVVTLWYRPPDVLLGSKNYNTSIDIWSVGCIFGEMSNLKPLFAGSNETDQLKKIFRVLGTPSPIEYPKLNDLPSWKPENFEQYQPDNLAKFCPRLDPDGLDLLVKMLKINPDQRITAKAACEHPFFKELPEQVKKLYVNVK

SEQ ID NO: 26107 - protein, 520 aa, Saccharomyces cerevisiae
ETVVPISTYAGQLFNDIIIDLVESLEFNRKEVARQVITLDLFFKAGIFTEPGESIAQLIATYEENPLAPTFKIEDLAIETILGLIFKLPSVSQPFAYFYTLLVDICQNSPKAIAPVFGRAFRFFYSHLDSLDFELKLRYLDWFSIQMSNFNFSWKWNEWEDDSIKFGKYFYNPKVNFAKNLIQKELRLTSNFSEVEDSLPQEFTKYLDTSYIPRDQLINYYQSLFTGYTVEEDSVRKNDLYFRQEGVPMENTVRKILDYTHKANNSREVTELESILGELKNEYGSIISDFNRFVIILLVQAVTDSGSRSLSHANKYINDLKEDLKTIFAKIELDIETKEYIIIEAVLTFWNANPQTGFLVADAFKYAGLLTSRTIFTFIFNETGLKNNGLIEATAIEAVFRNLSQQISEENESGNNFEFVFERLCTIANSTIDLLDVNADEDIEIPKVNGEMDIDDIEDDKLDLKWKYFTVIGFIKSILRRYSHEYRELADKFIANIDNAIPHESTRRTISNWIQETKEV

SEQ ID NO: 26108 - protein, 263 aa, Drosophila melanogaster
MTVNELRKSSKDDEVIALAKTLIKNWKRFLASPAPTTPNNSSAKEGSSNNSSASKSTSAAKSSSSISGKDKSSSSSSSKDKEKKGSTSSSQTSFPSGGMTDAVRIKCREMLATALKIGEVPEGCGEPEEMAAELEDAIYSEFNNTDMKYKNRIRSRVANLKDPKNPGLRGNFMCGAVTAKQLAKMTPEEMASDEMKKLREKFVKEAINDAQLATVQGTKTDLLKCAKCKKRNCTYNQLQTRSADEPMTTFVMCNECGNRWKFC

SEQ ID NO: 26109 - protein, 374 aa, Struthio camelus
STAGKVIKCKAAVLWEPKKPFSIEEVEVAPPKAHEVRVKIIATGICRSDDHVISGVLVMPFPIILGHEAAGVVESVGEGVTSVKPGDKVIPLFVPQCGECSVCLSTKGNLCRKNDIGPASALMPDGTSRFTCKGKAIHHFAGTSTFTEYTVLHETAVAKIDAAAPLEKVCLIGCGFSTGYGAALQTAKVEPGSTCAVFGLGGVGLSVVMGCKAAGASRIIGVDINKDKFAKAKELGATDCVNPKDFTKPIHEVLMEMTGLGVDYSFEVIGHTETMAAALASCHFNYGVSVIVGVPPAAEKLSFDPMLLFSGRTWKGSVFGGWKSKDSVPKLVADYMEKKFVLDPLITHTLPFHKINEGFDLLRTGKSIRSVLLF

SEQ ID NO: 26110 - protein, 369 aa, Photobacterium damselae subsp. piscicida
MKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDATSRFFVNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 26111 - protein, 376 aa, Myxine glutinosa
SKMDGQVIHCKAAVAWEAKKPLSLEEIEVAPPKAHEVRMKVLATAVCHTDAYTLSGVDPEGSFPVVLGHEGAGIVESVGEGVTKFKPGDSVIPLYIPQCGECKFCLNPKTNLCQKIRVTQGKGMMPDGTSRLTCRGKSLYHFMGASTFSEYAVVADISLCRVAPEAPPDRVCLLGCGVSTGYGAPLNTAKVEPGSTCAIFGLGAVGLAAIMGCRVAGASRIIAIDRNPDKFEKARIFGATDCVVPDASDKPISQVLGEMTDGGLDYTFECVGNVGIMRAALESCHKGWGVSVILGVAGGGQEISTRPFQLVTGRTWKGAAFGGWKSVESVPKLVDDYMAGKIMVDEFVSHSLPFDSINEAFDLMHAGKSIRTVLQL

SEQ ID NO: 26112 - protein, 856 aa, Brassica oleracea
MKGVRNIYHHSYTSLLLVYVVMILFHPGLAIYITTLSATESLTISSNRTLVSPGNVFELGFFKTTSSSRWYLGIWYKKLPDRTYVWIANRDNPLPNTIGTLKISGNNLVILGHSNKSVWSTNVTRGNERSPVVAELLANGNFVMRDSNNTDANEFLWQSFDFPTNTLLPEMKLGYDLKTGLNRFLTSWRGSDDPSSGDHLYKLEPRSFPEFYIFNDDFPVHRIGPWNGIEFSGIPEDQKSSYMVYNFTENSEEVAYSFRMTNNSIYSRLIISSEGYLQRLIWTPSTKIWQEFWSSPVSLQCDPYRICGPYAYCDENTSPVCNCIQGFDPKNQQQWDLRSHASGCIRRTWLSCRGDGFTRMKNMKLPDTTAAIVDRSVGVKECEKKCLSNCNCTAFANADIRNGGTGCVIWTGELEDIRNYVADGQDLYVRLAAADLVKKRNSNGKIIGLIVGVSVLLLLIISCLWKRRQKRAKASATSIANRQRNQNMPMNGMVLSSKRQLSGENKIEDLELPLIELEAVVKATENFSSCNKIGEGGFGIVYKGRLLDGQEIAVKRLSKTSFQGTDEFMNEVTLIARLQHINLVQVLGCCIEGDEKMLIYEYLENLSLDSYLFGKTRSSKLSWKERFDITNGVARGLLYLHQDSRFRIIHRDLKVSNILLDKNMIPKISDFGMARIFARDETEANTMKVVGTYGYMSPEYAMNGIFSEKSDVFSFGVIVLEIVTGKRNRGFYNLNYKNNFLSYAWSNWKEGRALEIVDPVIVDSLSPLSSTFQPQEVLKCIQIGLLCVQELAEHRPTMSTVVWMLGSEATEIPQPKPPGYCVGSSPYELDPSASRQLDDDESWTVNQYTCSVIDAR

SEQ ID NO: 26113 - protein, 859 aa, Brassica oleracea
MKGVRNIYYHSYTCFFLVFVVLILFHPAHSIYLNILSSTETFTISGNRTLVSPGDVFELGFFKTTSSSRWYLGIWYKKVYFRTYVWIANRDNPLSSSIGTLKISNMNLVLLDHSNKSVWSTNLTRGNERSPVVAELLANGNFVMRFSNNNDENEFLWQSFDFPTDTLLPEMKLGYNLKTGLNRILTAWRNLDDPSSGDYYYKLEKRELPEFYVLRNGFEIHRSGPWNGVRFSGIPENLKLSYMVYNFTENSEEVAYTFRMTNSSIYSRLKVSSDGYLQRLTLIPKSILWNLFWSSPVDIRCDVYKVCGRYSYCDGNTSPLCNCIQGFDPWNMEQWNMGEAASGCIRRTPLRCSDDGFTRMRRMKLPETTNAIVDRSIGVKECEKRCLSDCNCTAFANADIRNGGTGCVIWTGELEDIRTYYDDGQDLYVRLAAADLVKKRNANWKIISLIVGVTVVLLLLLLIMFCLWKRKQNRAKAMATSIVNQQRNQNVLMMNGMTQSNKRQLSRENKADEFELPLIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAITNGVARGLLYLHQDSRFRIIHRDLKPGNILLDKYMIPKISDFGMARIFARDETQAMTDNAVGTYGYMSPEYAMDGVISEKTDVFSFGVIVLEIVSGKRNRGFYQVNPENNLLSYAWSHWAEGRALEIVDPVIVDSLSSLPSTFQPKEVLKCIQIGLLCIQERAEHRPTMSSVVWMLGSEATEIPQPKPPVYCLIASYYANNPSSSRQFDDDESWTVNKYTCSVIDAR

SEQ ID NO: 26114 - protein, 266 aa, Gossypium hirsutum
LSIEEVEVAPPQKDEVRIKILFTSLCHIDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQANKFGVTDFVNPKDYNKPVQEVIVEMTGGGVDRSVECTGSIQAMISAFECVHD

SEQ ID NO: 26115 - protein, 266 aa, Gossypium hirsutum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 26116 - protein, 266 aa, Gossypium herbaceum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTDFVNPKDYNKPVQEVIVEMTGGGVDRSVECTGSIQAMISAFECVHD

SEQ ID NO: 26117 - protein, 266 aa, Gossypium raimondii
LSIEEVEVAPPQKDEVRIKILFTSLCHTDVHFWDAKGQNPLFPRILGHEAGGIVESVREGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTESVNPKDYNKPVQEVVVEMTGGGVDRSVECTGSIQAMISAFECVHD

SEQ ID NO: 26118 - protein, 266 aa, Gossypium robinsonii
  unsure (1)..(266): unsure at all Xaa locations
LSIEEVEVAPPQKDEVRIKILFTSLCHTDVYFWDAKGQNPLFPRILGHEAGGIVESVXKGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 26119 - protein, 1238 aa, Bordetella parapertussis
MPAPHRLYPRSLICLAQALLVWALLAWAPAQASQELTLVGKAAVPDVEIALDGDDWRWLARKRVLTLGVYAPDIPPFDVTYDERYEGLTADYMAIIAHNLGVQAKVLRYPTREQAVGALESGQIDLIGTVNGIEGRLQSLRLSVPYAADHPVLVMPIGARRAPPADLAGQRLAVDANYLPRETLQQAYPQATLHYFPSSEQALAAVAYGQADVFIGDALTTSHLVSQSYFNDVRVVAPAQIVTGGESFGVRADNTRLLRVVNAVLEAIPASERRSLIYRWGLGSSISLDFARPAYSAREQQWMANHPVVKVAVLNLFAPFTLFRTDEQFGGISAAVLQLLQLRTGLDFQIIGVDTVEELIAKLRSGEADMAGALFVNAARESVLSFSRPYVRNGMVIVTRQDPAAPADADHLDGRTIAMVRNSAAIPLLQQRYPQAKVVTADNPTEAMLLVADGQADAVVQTQISASYYVNRYFAGKLRIASALDLPPAEIALATARGQTELISILNKALYSISNDELASIVSRWRGSDGDPRTWYAYRNEIYLLIGLGLLSALLFLSWIVYLRRQIRQRKRAERALNDQLEFMRVLIDGTPNPIYVRDKEGRMLLCNDAYLDTFGVTADAVLGKTIPEANVVGDPALAREMHEFLLTRMAAEREPRFEDRDVTLHGRTRHVYQWTVPYGDSLGELKGIIGGWIDITERAELLRELHDAKESADAANRAKTTFLATMSHEIRTPMNAIIGMLELALLRPADQEPDRQSIQVAYDSARSLLELIGDILDIAKIEAGKFDLAPVRTALRALPEGAIRLFDGLARQKGIELVLKTDIVGVDDVLIDPLRMKQVLSNLVGNAIKFTTEGQVVLTVTARPDGEAAHVQFSVSDTGCGISEADQRQLFKPFSQVGGSAEAGPAPGTGLGLSISRRLVELMGGTLVMRSAPGVGTTVSVDLRLTMIEKSAQATPPAAAAQATPSKPQVSLRVLVVDDHKPNLMLLRQQLDYLGQRVVAADSGEAALALWHEHAFDVVITDCNMPGINGYELARRIRAAEAAPGYGRTRCILFGFTASAQMDEAHACRAAGMDDCLFKPIGVDALRQRLNEAAARAALPTPPSPQAAAPATHDATPAAFSAESILALTQNDEALIRQLLEEVIRTNRADVDQLQKLHQQADWPKVSDMAHRLAGGARVVDAKAMIDTALALEKKAQGQAGPSPEIDGLVRTLAAQSAALETQLRAWLEQRPHQGQP

SEQ ID NO: 26120 - protein, 1238 aa, Bordetella pertussis
MPAPHRLYPRSLICLAQALLAWALLAWAPAQASQELTLVGKAAVPDVEVALDGDDWRWLARKRVLTLGVYAPDIPPFDVTYGERYEGLTADYMAIIAHNLGMQAKVLRYPTREQALSALESGQIDLIGTVNGTDGRQQSLRLSVPYAADHPVIVMPIGARHVPASNLAGQRLAVDINYLPKETLARAYPQATLHYFPSSEQALAAVAYGQADVFIGDALTTSHLVSQSYFNDVRVVAPAHIATGGESFGVRADNTRLLRVVNAVLEAIPPSEHRSLIYRWGLGSSISLDFAHPAYSAREQQWMADHPVVKVAVLNLFAPFTLFRTDEQFGGISAAVLQLLQLRTGLDFEIIGVDTVEELIAKLRSGEADMAGALFVNSARESFLSFSRPYVRNGMVIVTRQDPDAPVDADHLDGRTVALVRNSAAIPLLQRRYPQAKVVTADNPSEAMLMVANGQADAVVQTQISASYYVNRYFAGKLRIASALDLPPAEIALATTRGQTELMSILNKALYSISNDELASIISRWRGSDGDPRTWYAYRNEIYLLIGLGLLSALLFLSWIVYLRRQIRQRKRAERALNDQLEFMRVLIDGTPNPIYVRDKEGRMLLCNDAYLDTFGVTADAVLGKTIPEANVVGDPALAREMHEFLLTRVAAEREPRFEDRDVTLHGRTRHVYQWTIPYGDSLGELKGIIGGWIDITERAELLRELHDAKESADAANRAKTTFLATMSHEIRTPMNAIIGMLELALLRPTDQEPDRQSIQVAYDSARSLLELIGDILDIAKIEAGKFDLAPVRTALRVLPEGAIRVFDGLARQKGIELVLKTDIVGVDDVLIDPLRMKQVLSNLVGNAIKFTTEGQVVLAVTARPDGDAAHVQFSVSDTGCGISEADQRQLFKPFSQVGGSAEAGPAPGTGLGLSISRRLVELMGGTLVMRSAPGVGTTVSVDLRLTMVEKSVQAAPPAAATAATPSKPQVSLRVLVVDDHKPNLMLLRQQLDYLGQRVIAADSGEAALALWREHAFDVVITDCNMPGISGYELARRIRAAEAAPGYGRTRCILFGFTASAQMDEAQACRAAGMDDCLFKPIGVDALRQRLNEAVARAALPTPPSPQAAAPATDDATPTAFSAESILALTQNDEALIRQLLEEVIRTNRADVDQLQKLHQQADWPKVSDMAHRLAGGARVVDAKAMIDTVLALEKKAQGQAGPSPEIDGLVRTLAAQSAALETQLRAWLEQRPHQDQP

SEQ ID NO: 26121 - protein, 301 aa, Trypanosoma brucei brucei
MGSRYERLQKIGEGSYGVVFRARDVTTGTIVAVKRIRLEKEEEGVPCTAIREISILKELRHENIVRLLDVCHSEKRLTLVFECMEMDLKKYMDHVGGDLDAGTIQEFMRSLLSGVRFCHERNVLHRDLKPPNLLISREKELKLADFGLGRAFGIPVKKFTQEVVTLWYRSPDVLLGSTQYGTPVDIWSVGCIFAEMAIGAPLFTGKNDADQLLRIFQFLGTPNRQVWPSMDTYPNSSNMLSRPEFQQTLAATCEEQFQTNPAYAKLGPQGIDLLRWLLRYEPSERLTAAQALEHPYFSVEF

SEQ ID NO: 26122 - protein, 298 aa, Rattus norvegicus
MVAPRPLCRLVLLYQAKQYSMAGNFWQSSHYLQWILDKERQKDLKFLSEEEYWKLQIFFTNVIQALGEHLKLRQQVIATATVYFKRFYARYSLKSIDPVLMAPTCVFLASKVEEFGVVSNTSLIAATTSVLKTRFSYASPKEFPYRMNHILECEFYLLELMDCCLIVYHPYRPLLQYVQDMGQEDVLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 26123 - protein, 403 aa, Gallus gallus
MPVARSSKAQSSKQPRASKAPSVTENVPPEKEEGCQAKRSPSSPQGGPKKRSAFGDITNAHKNQVVTGKKEGVKAPTRKATRAPPAPIVAKNNEINLKKSLRKTPPADVPVEPEKDSVPEEPVQQVPVVEDIDKEQLGDPYANAEYAKEIFDYMREREEKFLLPDYMEKQSDISRDMRAILVDWMVEVQENFELNHETLYLAVKLVDHYLVEVVSMRDKLQLIGSTAVLIASKFEERCPPCVDDFLYICDDAYKREELIAMETSILRTLNFDINIPIPYRFLRRFAKCARASMETLTLARFVCEMTLQEYDYARERPSKLAASSLLLALTMKNLGGWTPTLEYYSGYCAQDLHPLVKRLNFLLTYQPCDKLKAVRTKYSHRVFFEVAKTTPMDMMKLEEKLKS

SEQ ID NO: 26124 - protein, 295 aa, Rattus norvegicus
MEHQLLCCEVETIRRAYPDTNLLNDRVLRAMLKTEETCAPSVSYFKCVQREIVPSMRKIVATWMLEVCEEQKCEEEVFPLAMNYLDRFLSLEPLKKSRLQLLGATCMFVASKMKETIPLTAEKLCIYTDNSIRPEELLQMELLLVNKLKWNLAAMTPHDFIEHFLSKMPEADENKQIIRKHAQTFVALCATDVKFISNPPSMVAAGSVVAAMQGLNLGSPNNFLSCYRTTHFLSRVIKCDPDCLRACQEQIEALLESSLRQAQQNIDPKATEEEGEVEEEAGLACTPTDVRDVDI

SEQ ID NO: 26125 - protein, 432 aa, Bacillus methanolicus
MYFHGTTKVNEKGHLEIGGVDTIELAQKYGTPLYVYDVALIRERARGFKNTFDELGIKAQVAYASKAFSTVAMIQLAEEEGLSLDVVSGGELYTALVAGFPVHKIHFHGNNKSRAELEMALEHQIGCIVVDNFHELDLIDSICSEKNVKTNILLRVTPGIEAHTHDYILTGQEDSKFGFDLQNGQAEKALQIALNSNFVEVLGVHCHIGSQIFDTTGFVLAARKIFEKLKEWKDRLSYEPKVLNLGGGFGIRYTEEDDPIPASQYVKEIINEVKKQVSAYSMKMPEIWIEPGRSLVGDAGTTLYQIGSRKDVPNVRHYVAVDGGMSDNIRPALYNAKYEAVLANKPLAKADETVSIAGKCCESGDMLIWDLPLPKADSDDILAVFCTGAYGYSMANNYNRIPRPAVVFVENGESMLVVKRKHMRTSSAMICL

SEQ ID NO: 26126 - protein, 393 aa, Drosophila melanogaster
MVNGDLRIQYYDEELNIRKVIEQADLEHLDQALNICDLSSLERKLRLWHKLMPRIEPHYAVKCNDDPVVVKFLADLGTGFDCASKNELKLVLGFGVSPERIIFAHPCRPASHLRYAKEQQVVNGTVDNEYEIYKLRKHYPDSSLIVRFKSEAKKALCPLGDKYGCDAEADAAALMLLAKALGLKVTGTSFHVGSGCSEVEAYDRAIEKAENIFKVGEMIGHKMELLDVGGGFPGIDDEMFKEIAQSVNTSVELRFPDKRIRIISEPGRFFVEAAYTLICKVHAKREVRSKDGKLDTMMYYLNDGIFGAFAGMFYYPEEVAPELYLDEAESLPKLKSVIWGPSCDALDKISDLLLPNLNPGDLLGFRNMGAYTMPIASPFNGFDVPETRFFKAK

SEQ ID NO: 26127 - protein, 496 aa, Cladosporium herbarum
MTSVQLETPHSGKYEQPTGLFINNEFVKGQEGKTFDVINPSDESVITQVHEATEKDVDIAVAAARQAFEGSWRLETPENRGKLLNNLANLFEKNTDLLAAVESLDNGKATSMARVTSACASGCLRYYGGWADKITGKVIDTTPDTFNYVKKEPIGVCRSDHSLELPLLMWAWKIGPAIACGNTVVLKTAEQTPLGGLVAASLVKEAGFPPGVINVISGFGKVAGAALSSHMDVDKVAFTGSTVVGRTILKAAASSNLKKVTLELGGKSPNIVFEDADIDNAISWVNFGIFFNHGQCCCAGSRVYVQESIYDKFVQKFKERAQKNVVGDPFAADTFQGPQVSKVQFDRIMEYIQAGKDAGATVETGGSRKGDKGYFIEPTIFSNVTEDMKIVKEEIFGPVCSIAKFKTKEDAIKLGNASTYGLAAAVHTKNLNTAIEVSNALKAGTVWVNTYNTLHHQMPFGGYKESGIGRELGEDALANYTQTKTVSIRLGDALFG

SEQ ID NO: 26128 - protein, 261 aa, Bacillus megaterium
MYKDLEGKVVVITGSSTGLGKAMAIRFATEKAKVVVNYRSKEEEANSVLEEIKKVGGEAIAVKGDVTVESDVINLVQSSIKEFGKLDVMINNAGMENPVSSHEMSLSDWNKVIDTNLTGAFLGSREAIKYFVENDIKGTVINMSSVHEKIPWPLFVHYAASKGGMKLMTETLALEYAPKGIRVNNIGPGAINTPINAEKFADPEQRADVESMIPMGYIGEPEEIAAVAAWLASSEASYVTGITLFADGGMTQYPSFQAGRG

SEQ ID NO: 26129 - protein, 261 aa, Bacillus megaterium
MYTDLKDKVVVVTGGSKGLGRAMAVRFGQEQSKVVVNYRSNEEEALEVKKEIEEAGGQAIIVRGDVTKEEDVVNLVETAVKEFGSLDVMINNAGVENPVPSHELSLENWNQVIDTNLTGAFLGSREAIKYFVENDIKGNVINMSSVHEMIPWPLFVHYAASKGGMKLMTETLALEYAPKGIRVNNIGPGAIDTPINAEKFADPEQRADVESMIPMGYIGKPEEIASVAAFLASSQASYVTGITLFADGGMTKYPSFQAGRG

SEQ ID NO: 26130 - protein, 261 aa, Bacillus megaterium
MYTDLKDKVVVITGGSTGLGRAMAVRFGQEEAKVVINYYNNEEEALDAKKEVEEAGGQAIIVQGDVTKEEDVVNLVQTAIKEFGTLDVMINNAGVENPVPSHELSLDNWNKVIDTNLTGAFLGSREAIKYFVENDIKGNVINMSSVHEMIPWPLFVHYAASKGGMKQMTETLALEYAPKGIRVNNIGPGAMNTPINAEKFADPVQRADVESMIPMGYIGKPEEVAAVAAFLASSQASYVTGITLFADGGMTKYPSFQTGRG

SEQ ID NO: 26131 - protein, 261 aa, Bacillus megaterium
MYTDLKDKVVVITGGSTGLGRAMAVRFGQEEAKVVINYYNNEEEALDAKKEVEEAGGQAIIVQGDVTKEEDVVNLVQTAIKEFGTLDVMINNAGVENPVPSHELSLDNWNKVIDTNLTGAFLGSREAIKYFVENDIKGNVINMSSVHEMIPWPLFVHYAASKGGMKLMTETLALEYAPKGIRVNNIGPGAMNTPINAEKFADPVQRADVESMIPMGYIGKPEEVAAVAAFLASSQASYVTGITLFADGGMTKYPSFQAGRG

SEQ ID NO: 26132 - protein, 261 aa, Bacillus megaterium
MYKDLEGKVVVITGSSTGLGKSMAIRFATEKAKVVVNYRSKEDEANSVLEEIKKVGGEAIAVKGDVTVESDVINLVQSAIKEFGKLDVMINNAGLENPVSSHEMSLSDWNKVIDTNLTGAFLGSREAIKYFVENDIKGTVINMSSVHEKIPWPLFVHYAASKGGMKLMTETLALEYAPKGIRVNNIGPGAINTPINAEKFADPEQRADVESMIPMGYIGEPEEIAAVAAWLASSEASYVTGITLFADGGMTQYPSFQAGRG

SEQ ID NO: 26133 - protein, 261 aa, Streptomyces cinnamonensis
MTQSTSRVALVTGATSGIGLATARLLAAQGHLVFLGARTESDVIATVKALRNDGLEAEGQVLDVRDGASVTAFVQAAVDRYGRIDVLVNNAGRSGGGVTADLTDELWDDVIDTNLNSVFRMTRAVLTTGGMRTRERGRIINVASTAGKQGVVLGAPYSASKHGVVGFTKALGNELAPTGITVNAVCPGYVETPMAQRVRQGYAAAYDTTEEAILTKFQAKIPLGRYSTPEEVAGLIGYLASDTAASITSQALNVCGGLGNF

SEQ ID NO: 26134 - protein, 210 aa, Petunia x hybrida
MGRGKIEIKRIENSSNRQVTYSKRRNGILKKAKEISVLCDARVSVIIFASSGKMHEFSSTSLVDILDQYHKLTGRRLLDAKHENLDNEINKVKKDNDNMQIELRHLKGEDITSLNHRELMILEDALENGLTSIRNKQNEVLRMMRKKTQSMEEEQDQLNCQLRQLEIATMNRNMGEIGEVFQQRENHDYQNHMPFAFRVQPMQPNLQERL

SEQ ID NO: 26135 - protein, 399 aa, Saccharomyces cerevisiae
MLAEKTRSIIKATVPVLEQQGTVITRTFYKNMLTEHTELLNIFNRTNQKVGAQPNALATTVLAAAKNIDDLSVLMDHVKQIGHKHRALQIKPEHYPIVGEYLLKAIKEVLGDAATPEIINAWGEAYQAIADIFITVEKKMYEEALWPGWKPFEITAKEYVASDIVEFTVKPKFGSGIELESLPITPGQYITVNTHPIRQENQYDALRHYSLCSASTKNGLRFAVKMEAARENFPAGLVSEYLHKDAKVGDEIKLSAPAGDFAINKELIHQNEVPLVLLSSGVGVTPLLAMLEEQVKCNPNRPIYWIQSSYDEKTQAFKKHVDELLAECANVDKIIVHTDTEPLIDAAFLKEKSPAHADVYTCGSVAFMQAMIGHLKELEHRDDMIHYEPFGPKMSTVQV

SEQ ID NO: 26136 - protein, 149 aa, Pisum sativum
MDASTKVKKGAGGRKGGGPRKKAVTRSVRAGLQFPVGRIGRFLKKGRYAQRVGTGAPVYLAAVLEYLAAEVLELAGNAARDNKKNRISPRHLLLAVRNDVELGKLLAGVTIAYGGVLPNINPVLLPKRTESAASAPKSPSKAKKTPKKA

SEQ ID NO: 26137 - protein, 136 aa, Euglena gracilis
MSTTTPPPAKGGKDKKGAKAGVKKGKTGGSGQSKKAGLTFPVGRTGSLLRAGRYAKRVGKGAPVYLAAVLEYLSAELLELAGNASRDNKKKRITPRFLTLAVRNDEELNKLLSGVTIASGGVLPNIQQVLLKKKGK

SEQ ID NO: 26138 - protein, 118 aa, Entamoeba histolytica
MATDTGSGRGKGGKGVTLGKGSKGAKASKGGKRIRTKTQQDALKGITKPAIRRLARRGGVKRINGAVYDETRNVLKQFLEQVIRDSVTYTEHAKRRTVTAMDVVYALKRQGRTLYGYS

SEQ ID NO: 26139 - protein, 205 aa, Kluyveromyces lactis
MDTETEAEKQERHNNYLNELAEQDRWLPINNVARLMKNTLPATTKVSKDAKECMQECVSEFISFVTSEACDRCTSGKRKTINGEDILLSLHALGFENYAEVLKIYLAKYRQQQAIKNQMMYPKEDVEGSYTEEESRAEDADHVTQERQQPLHPVPSSASTTTSTEVSASEHVQSSSKSTHNPAQAQPRIVVQQPLGSRHSTADHL

SEQ ID NO: 26140 - protein, 114 aa, Chironomus tentans
MAEKPKRPLSAYMLWLNSARESIKKENPDFKVTEIAKKGGELWRGMKDKSEWEAKAAKMKEEYEKAMKEFERNGGDKSSGASTKKRGKAAEKKKPAKKSKKKDSEDDEEEDESD

SEQ ID NO: 26141 - protein, 200 aa, Strongylocentrotus purpuratus
MGKKDRDSSKPRGRMSAYAYFVQDSRAEHGKNHPNSPVRFAEFSKDCSARWKALEEKGKGVFHEKSMRDKVRYDREMQSYKPPKGEKNKRRRRRKDPDAPKRNLSAFFIFSGENRAAIKSVHPNWSVGDIAKELAVRWRAMTAGEKIPFDKGAAKDKERYIKAMAEYKAKAKPMKRQVKESSSSSSSDSSSDDSSSDDSD

SEQ ID NO: 26142 - protein, 403 aa, Ralstonia eutropha [sequence omitted]

SEQ ID NO: 26143 - protein, 200 aa, Drosophila melanogaster
MSSMGDQRGTRVYVGNLTDKVKKDDLEGEFTKYGKLNSVWIAFNPPGFAFVEFEHRDDAEKACDILNGSELLGSQLRVEISKGRPRQGRRGGPMDRGGRRGDFGRHSITSGGSGGGGFRQRGSSGSSSRHTERGYSSGRSGASSYNGREGGGSGFNRREVYGGGRDSSRYSSGSSASYGRTGGQSAGRFRSRSPVGNHRF

SEQ ID NO: 26144 - protein, 351 aa, Lycopersicon peruvianum
MEDVMKVKVEEDGIPTAVLPMEGLHDVGPPPFLSKTYEMVEDSSTDQVISWSTTRNSFIVWDSHKFSTTLLPRFFKHSNFSSFIRQLNTYGFRKVDPDRWEFANEGFLGGQKHLLKTIKRRRNVGQSMNQQGSGACIEIGYYGMEEELERLKRDKNVLMTEIVKLRQQQQSTRNQIIAMGEKIETQERKQVQMMSFLAKIFSNPTFLQQYLDKQVHRKDKQRIEVGQKRRLTMTPSVTGSDQPMNYSSSLQESEAELASIEMLFSAAMDNESSSNVRPDSVVTANGTDMEPVADDIWEELLSEDLISGDRAAEEVVVVEQPEFDVEVEDLVVKTPEWGEELQDLVDQLGFL

SEQ ID NO: 26145 - protein, 527 aa, Lycopersicon peruvianum
MEPNSSGSGKAAVGDGGGGGAPMLQPAPAPAPMPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGHAQQQMQPPGHSASVGACVEVGKFGLEEEVERLKRDKNVLMQELVRLRQQQQSTDNQLQGMVQRLQGMELRQQQMMSFLAKAVNSPGFLAQFVQQQNESNKRIAEGSKKRRIKQDIESQDPSVTPADGQIVKYQPGINEAAKAMLRELSKLDSSPRLENFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTIAVEGKMGLDIGSLSPGADIDWQSGLLDEIQEFPSVGDPFWEKFLQSPSSPDAAMDDDISNTSETKPQINGWDKTQNMEHLTEQMGATNIKQQKHMI

SEQ ID NO: 26146 - protein, 451 aa, Xenopus laevis
MDPHGTCGGSNVPAFLAKLWTLVEDPDTDPLICWSPEGNSFHVFDQGQFAKEVLPKYFKHNNMASFVRQLNMYGFRKVVHIEQGGLVKPERDDTEFQHPYFIRGQEQLLENIKRKVNTMSATKSDEVKVRQDSVGKLISDVQSMKGKQESIDGRLLSMKHENEALWREVASLRQKHTQQQKVVNKLIQFLVSLVQSNRILGVKRKIPLMLNDSSTGHSPPKYSRQYSLEHVPSSTSYPVSGFTDSSAGPIISDVTELPESSPSPSPCPSLEASPSPVILIKTEPLTPSQSPEQSPAPPKLDDTPISPSTFIDSILLETETSVCPGGNKNDEMSESHPPEPCLSVACLDNISLSRQMSEVSRLFPTSCSSVPGRAEPPGLDMAVAELNDHVDNIDFNLDTLQNLLNGQSFSVDTSALMDLFSPSLGIPDLSLPDPDSSLASVSSTPIYTCVV

SEQ ID NO: 26147 - protein, 2470 aa, Drosophila melanogaster
MSTTSVVQQFVNGLKSRNRNVQNKATQDLLFYVKTELREMSQEELAQFFDEFDHHIFTMVNATDINEKKGGALAMKCLINCEGSLTARKGISPYLNRLRDLLLINDVSVMEIAARSLVKLANMPTSKGADSFDFDIKKAFEVLRGERQEYRRHSAVFILRELAIALPTYFYQHILTFFEVIFNAIFDPKPAIRESAGEALRAALIVTAQRESTKQSSEPQWYRICYDEANGSFNADLGSSKDQKGVTRDDRIHGGLVVFNELFRCANATWERRYTSLKTLFPKTQHNKFLEASSSSSMGSQLNTLVPRLKVPFIDKLGSTQTHLGEGEHHKGVAKFASHNVLESAYAQEILQEHYTSICDNVLEQRTSKSPYVQQALLQILPRLAAFNRAVFVEKYLQTCVSHLMQILRGKEKDRTVAYITIGYMAVAVQSAIEVHLSSIMTSVKVALPSKDLTSKRKVPVDPAVFACITLLAHAVKSEIADDVKDILEQMFYTGLSPALTVCLRELSENVPQLKSAITEGLIGILSQVLMNKAAILPYTALPTIAIDGSLMQNGDGATTVLALKTLGTFNFEEQNMLDFVQRCADYFIVHEQQEIRLEAVQTCTRLLKLAVQSSESMENSKTLSDTVSHVIERLLMVAITDMDCNVRIRILRSLDETFDGKLAQPESLNSLFITLHDEIFEIRELAMVTIGRLSSINPAYVMPKLRTTMIELITDLKYSGMSRNKEQSAKMLDHLVISTPRLISSYMNPILKALVPKLHEPESNPGVILNVLRTIGDLAEVNGGSDEMELWADDLLSILLEMLGDAGSPDKRGVALWTLGQLISATGRVVTPYHKYPVLIDILINFLKTEQRRSIRRETIRVLGLLGAMDPYKHKMNKGLIDSQKDNVLIAYSDGKVDESQDISTAELLVNMGNALDEYYPAVAIAALMRILRDPTLSTRHTSVVQAVTFIFQSLGIKCVPYLAQVLPNLLDNVRTADNNLREFLFQQLAILVAFVKLHIISYMGDIFKLIKEFWTINTPLQNTLINLIEQIAVALGCEFRDYLAELIPQILRVLQHDNSKDRMVTRRLLQALQKFGSTLGYYLPLILPPIVKLFDSPYVPQQVSMVALETINNLACQLDFTDFSSRIIHPLVRVLDAEPELRDQAMTTLRSLAKQLGKKYLVFVPMVQRTLNKHRIVDPEYEELLSKIKSCSTLADSYGAGESELRPSRFKNNEPFVTDRNSNNKNLQVTTNELRTAWQVTRRVSKDDWVEWLKRLSIGLLKESPSHALRACRSLAQEYDTLLRDLFNAAFISCWTELSPDLKNELTQSLIQALQVTDMPEITQTILNLAEFMEHCDRDPIPIETKLLGTRAMACRAYAKALRYKEEEFLLREDSQVFESLILINNKLQQREAAEGLLTRYRNAANELNVQGRWYEKLHNWDEALEHYERNLKTDSSDLEARLGHMRCLEALGDWSELSNVTKHEWENFGTEAKSRAGPLAAVAAWGLQDWEAMREYVRCIPEDTQDGSYYRAVLAVHHDDFETAQRLIDETRDLLDTELTSMAGESYERAYGAMVCVQMLAELEEVIQYKLIPERREPLKTMWWKRLQGGQRLVEDWRRIIQVHSLVVKPHEDIHTWLKYASLCRKSGSLHLSHKTLVMLLGTDPKLNPNQPLPCNQPQVTYAYTKYMAANNQLQEAYEQLTHFVSTYSQELSCLPPEALKQQDQRLMARCYLRMATWQNKLQDSIRPDAIQGALECFEKATSYDPNWYKAWHLWAYMNFKVVQAQKSALDKQQPPGASMGMTMGSGLDSDLMIIQRYAVPAVQGFFRSISLIKGNSLQDTLRLLTLWFDYGNHAEVYEALLSGMKLIEINTWLQVIPQLIARIDTHRQLVGQLIHQLLMDIGKNHPQALVYPLTVASKSASLARRNAAFKILDSMRKHSPTLVEQAVMCSEELIRVAILWHEQWHEGLEEASRLYFGDRNVKGMFEILEPLHAMLERGPQTLKETSFSQAYGRELTEAYEWSQRYKTSAVVMDLDRAWDIYYHVFQKISRQLPQLTSLELPYVSPKLMTCKDLELAVPGSYNPGQELIRISIIKTNLQVITSKQRPRKLCIRGSNGKDYMYLLKGHEDLRQDERVMQLFSLVNTLLLDDPDTFRRNLAIQRYAVIPLSTNSGLIGWVPHCDTLHTLIRDYRDKKKVPLNQEHRTMLNFAPDYDHLTLMQKVEVFEHALGQTQGDDLAKLLWLKSPSSELWFERRNNYTRSLAVMSMVGYILGLGDRHPSNLMLDRMSGKILHIDFGDCFEVAMTREKFPEKIPFRLTRMLIKAMEVTGIEGTYRRTCESVMLVLRRNKDSLMAVLEAFVYDPLLNWRLLDVDKKGNDAVAGAGAPGGRGGSGMQDSLSNSVEDSLPMAKSKPYDPTLQQGGLHNNVADETNSKASQVIKRVKCKLTGTDFQTEKSVNEQSQVELLIQQATNNENLCQCYIGWCPFW

SEQ ID NO: 26148 - protein, 1454 aa, Drosophila melanogaster
MQQQQQPSIDQLPEPTASTSNSATTKPTIATVTTSTTTTSGNNFHQQLQATTAATMQRLRTTFTRSRTPTGAEMKMQNSLEVPKQVRSASFDEMQLESQRASSSLLKQQSSSSASADERSSEAGFLQVPLAAHQQRSHSFDSATASAGSDDSGTFLEVPRRLKARRSSSTKTPPPCIHCHYLEEYERRMTAEQRYFIDHRELTALSYTNTSSEASEDEDEVEGHNAEEEEEGSAAIEDAEEETTEAATEEADEDPRTEVESEHDHDPDDDAALEMDIRIGNMSQGSSIEESRARLPRQMRRHTIGSSSVTSASEDEGLEGSDNGSPHFGNTLLPPQPTTPCGITFTLSPTNGDYPSPPHLPLDPGSPPISPCSSNSGRLPALAPIISTPCSSADADDAGAAMGLPVRARRRSISRQEAIFVEPTGNSLENVSHEEVDKSNTKSSVDTADSLDEASTMATCGSPGAAGGSGASSSHHNAFVVRDIYLMVPDLKRDRAASVDSCFSKLSSNAKTEELQPSADGCFLTVPNINATRSRSVDIVLPTDEQARYKALSMTGSTVTYADGRRTASASNSRRPIRIVPDWTENAVQGEHYWKPTSASGDLCCLNEECIKSGQRMKCSACQLVAHHNCIPFVNEKSTLACKPTYRDVGIRQYREQTTTHHHWVHRNLEKGKCKQCGKAVQSKLFGSKEIVALACAWCHEIYHNKEACFNQAKIGEECRLGNYAPIIVPPSWIVKLPTKGNFKSSIRVSNKNNAASGSGGGGAGGGAGGGGGGGKSKKQTQRRQKGKEEKKEPRAFIVKPIPSPEVIPVIVFINPKSGGNQGHKLLGKFQHLLNPRQVFDLTQGGPKMGLDMFRKAPNLRVLACGGDGTVGWVLSVLDQIQPPLQPAPAVGVLPLGTGNDLARALGWGGGYTDEPIGKILREIGMSQCVLMDRWRVKVTPNDDVTDDHVDRSKPNVPLNVINNYFSFGVDAHIALEFHEAREAHPERFNSRLRNKMYYGQMGGKDLILRQYRNLSQWVTLECDGQDFTGKLRDAGCHAVLFLNIPSYGGGTHPWNDSFGASKPSIDDGLMEVVGLTTYQLPMLQAGMHGTCICQCRKARIITKRTIPMQVDGEACRVKPSVIEIELLNKALMLSKRKHGRGDVQVNPLEKMQLHILRVTMQQYEQYHYDKEMLRKLANKLGQIEIESQCDLEHVRNMLNTKFEESISYPKVSQDWCFIDSCTAEHYFRIDRAQEHLHYICDIAIDELYILDHEAATMPQTPDQERSFAAFSQRQAQNERRQMDQAQGRGPGSTDEDLQIGSKPIKVMKWKSPILEQTSDAILLAAQSGDLNMLRALHEQGYSLQSVNKNGQTALHFACKYNHRDIVKYIIASATRRLINMADKELGQTALHIAAEQNRRDICVMLVAAGAHLDTLDSGGNTPMMVAFNKNANEIATYLESKQGTQPVDGWLDD

SEQ ID NO: 26149 - protein, 231 aa, Petunia x hybrida
MARGKIQIKRIENQTNRQVTYSKRRNGLFKKANELTVLCDAKVSIIMISSTGKLHEFISPSITTKQLFDLYQKTVGVDLWNSHYEKMQEQLRKLKEVNRNLRKEIRQRMGESLNDLNYEQLEELMENVDNSLKLIRERKYKVIGNQIETFKKKVRNVEEIHRNLLLEFDARQEDPYGLVEQEGDYNSVLGFPNGGHRILALRLQPNHHQPNHHHHLHSGGGSDITTFALLE

SEQ ID NO: 26150 - protein, 212 aa, Petunia x hybrida
MGRGKIEIKRIENSSNRQVTYSKRRNGIIKKAKEITVLCDAKVSLIIFGNSGKMHEYCSPSTTLPDMLDGYQKTSGRRLWDAKHENLSNEIDRIKKENDNMQVKLRHLKGEDINSLNHKELMVLEEGLTNGLSSISAKQSEILRMVRKNDQILEEEHKQLQYALHQKEMAAMGGNMRMIEEVYHQRDRDYEYQQMPFALRVQPMQPNLHERM

SEQ ID NO: 26151 - protein, 97 aa, Babesia bovis
MAGASDRTGVRRPRKAKKDPNAPKRALSSYMFFAKEKRVEIIAENPEIAKDVAAIGKMIGAAWNALSDEEKKPYERMSDEDRVRYEREKAEYAQRKV

SEQ ID NO: 26152 - protein, 226 aa, Drosophila melanogaster
MSAVAYDSLLSTTAVISTVFQFLSGAMICRKYIQKKSTGDSSGVPFICGFLSCSFWLRYGVLTNEQSIVLVNIIGSTLFLVYTLIYYVFTVNKRACVKQFGFVLTVLVVVIVYTNRLEDQRDRMIHVTGIVCCIVTVCFFAAPLASLLHVIRAKNSESLPLPLIATSFVVSLQWLIYGILISDSFIQIPNFLGCILSLLQLGLFVLYPPRSYSGHGYKLVEQAVPF

SEQ ID NO: 26153 - protein, 394 aa, Drosophila melanogaster
MAAATPEIQFYERELNIRRVIEECDLQRLDQALNICDLSSVERKLRLWQKLLPRIKPFYAVKCNDDPMVVRLLAQLGAGFDCASKNEVKLVLGFDVSPERIIFANPCRPVSHLEYAKEHQVSNGTVDNEFEVYKLHTHYPNSNLIVRFKSEAKEAQCPLGDKFGCDADVDAAALMLLAKSLELKVTGTSFHVGSGCSELQAYDRAIKKAKNLFKFGALLGYDMDFLDIGGGFPGSDDVKFEKIAESVNTSVQRHFPDERVHIIAEPGRFFVAAACTLVCKIHAKREIRNEAGKLDTVMYYLNDGVYGSFNCILYDHQVVIAEHYLDNAESLPHLKSLIWGPSCDALDKISEDLHLPNLNRGDLLGFRNMGAYTMPIASAFNGFEVPKTLYFQAI

SEQ ID NO: 26154 - protein, 419 aa, Mus musculus
MKLLSRDTRLVCELALCPLALVFWSILGVRALDNGLARTPTMGWLHWERFMCNLDCQEEPDACISEQLFMQMAELMVSDGWRDAGYDYLCIDDCWMAPERDSKGRLQADPQRFPSGIKHLANYVHSKGLKLGIYADVGNKTCAGFPGSFGSYDIDAQTFADWGVDLLKFDGCHCDSVVSLENGYKYMALALNRTGRSIVYSCEWPLYLRPFHKPNYTDIQYYCNHWRNFDDVYDSWESIKNILSWTVVYQKEIVEVAGPGSWNDPDMLVIGNFGLSWDQQVTQMALWAIMAAPLLMSNDLRQISSQAKALLQNKDVIAINQDPLGKQGYCFRKENHIEVWERPLSNLAWAVAVRNLQEIGGPCPYTIQISSLGRGLACNPGCIITQLLPEKVHLGFYEWTLTLKTRVNPSGTVLFRLER

SEQ ID NO: 26155 - protein, 367 aa, Mus musculus
MSSPPPARKGFYRQEVTKTAWEVRAVYQDLQPVGSGAYGAVCSAVDSRTGNKVAIKKLYRPFQSELFAKRAYRELRLLKHMRHENVIGLLDVFTPDESLDDFTDFYLVMPFMGTDLGKLMKHETLSEDRIQFLVYQMLKGLKYIHAAGVIHRDLKPGNLAVNEDCELKILDFGLARQADSEMTGYVVTRWYRAPEVILNWMRYTQTVDIWSVGCIMAEMITGKILFKGNDHLDQLKEIMKITGTPPPEFVQKLQSAEAKNYMEGLPELEKKDFASVLTNASPQAVNLLERMLVLDAEQRVTAAEALTHPYFESLRDTEDEPKAQKYDDSFDDVDRTLEEWKRVTYKEVLSFKPPRQLGARVPKETAL

SEQ ID NO: 26156 - protein, 461 aa, Mus musculus
MSSFTKDEFDCHILDEGFTAKDILDQKINEVSSSDDKDAFYVADLGDILKKHLRWLKALPRVTPFYAVKCNDSRAIVSTLAAIGTGFDCASKTEIQLVQGLGVPAERVIYANPCKQVSQIKYAASNGVQMMTFDSEIELMKVARAHPKAKLVLRIATDDSKAVCRLSVKFGATLKTSRLLLERAKELNIDVIGVSFHVGSGCTDPDTFVQAVSDARCVFDMATEVGFSMHLLDIGGGFPGSEDTKLKFEEITSVINPALDKYFPSDSGVRIIAEPGRYYVASAFTLAVNIIAKKTVWKEQPGSDDEDESNEQTFMYYVNDGVYGSFNCILYDHAHVKALLQKRPKPDEKYYSSSIWGPTCDGLDRIVERCNLPEMHVGDWMLFENMGAYTVAAASTFNGFQRPNIYYVMSRPMWQLMKQIQSHGFPPEVEEQDDGTLPMSCAQESGMDRHPAACASARINV

SEQ ID NO: 26157 - protein, 350 aa, Haloferax volcanii
MSESEVRQTEVIPQWKREEVDELVDFIESYESVGVVGVAGIPSRQLQSMRRELHGSAAVRMSRNTLVNRALDEVNDGFEELKEYIAGQVALIGTNDNPFALFKELEASKTPAPINAGEVAPNDIVIPEGDTGVDPGPFVGELQQVGASARIMDGSIMVTEDSNVLSEGEEVSEELANVLAELGIEPKEVGLDLRGVFSEGVLFEPDELAIDVDEYRADIQSASPAATNLSVNAVYPTAQTAPTLIAKATSEAKAVGLFANIESPDFMPELISKADAQLRALAANHSIDEEEALPEELRAVSAADTGAAEEEESTDEEAADADQADAAEDDDAADDDGDDEDAGDALGSLF

SEQ ID NO: 26158 - protein, 322 aa, Leishmania donovani chagasi
MPSITTAKREYEERLVDCLTKYSCVLFVGMDNVRSQQVHDVRRGCRGKAEFIMGKKTLQAKIVEKRAQAKDASPEAKPFNDQCEEYNLLSGNTGLIFTNNAVQEITSVLDGHRVKAPARVGAIPCDVVVPAGSTGMEPTQTSFFQALNIATKIAKGMVEIVTEKKVLSVGDKVDNSTATLLQKLNISPFYYQVNVLSVWDRGVLFTREDLMMTEDMVEKMLMEGLSNVAAMALGAGIPTSSTIGPMLVDAFKNLLAVSVATSYEFEEHNGKELREAAINGLLAGSGSAAAEPAAAAPAAPSAAAKEEPEESDEDDFGMGGLF

SEQ ID NO: 26159 - protein, 323 aa, Leishmania infantum
MPSITTAKREYEERLVDCLTKYSCVLFVGMDNVRSQQVHDVGRALRAKAEFMMGKKTLQGKIVEKRAQAKDASPEAKHFNDQCEEYNLLSGNTGLIFTNNAVQEITSVLDAHRVKRAARVGAISPCDVIVAAGSTGMEPTQTSFFQALNIATKIAKGMVEIVTEKKVLSVGDKVDNSTATLLQKLNISPFYYQVNVLSVWDRGVLFTREDLMMTEDMVEKMLMEGLSNVAAMALGAGIPTSSTIGPMLVDAFKNLLAVSVATSYEFEEHNGKELREAAINGLLAGSCSAAAEPAAAAPAAPSAAAKEEPEESDEDDFGMGGLF

SEQ ID NO: 26160 - protein, 319 aa, Oryza sativa
MAIKRTKAEKKVAYDKKLCQLLDEYTKVLIAVADNVGSNQLQEIRKGLRGDSIVLMGKNTLIRRCIKVHADNTGNKEFLELMPLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLVITNVYDSGSVFSPEVLDLTEDDLMEKFASGVSMVASVSLAISYPTIAAAPHMFLNGYKNVLAVAVETEYSYPHADKIKEYLKDPSKFAVAAPVAADSGAAAPSAAKEEEKKEEPEEESDGDLGMSLFD

SEQ ID NO: 26161 - protein, 849 aa, Brassica oleracea
MKGARNIYHHSYMSFLLVFVVMILIHPALSIYINTLSSTESLTISSNKTLVSPGSIFEVGFFRTNSRWYLGMWYKKVSDRTYVWVANRDNPLSNAIGTLKISGNNLVLLDHSNKPVWWTNLTRGNERSPVVAELLANGNFVMRDSSNNDASEYLWQSFDYPTDTLLPEMKLGYNLKTGLNRFLTSWRSSDDPSSGNFSYKLETQSLPEFYLSRENFPMHRSGPWNGIRFSGIPEDQKLSYMVYNFIENNEEVAYTFRMTNNSFYSRLTLISEGYFQRLTWYPSIRIWNRFWSSPVDPQCDTYIMCGPYAYCDVNTSPVCNCIQGFNPRNIQQWDQRVWAGGCIRRTQLSCSGDGFTRMKKMKLPETTMATVDRSIGVKECKKRCISDCNCTAFANADIRNGGSGCVIWTERLEDIRNYATDAIDGQDLYVRLAAADIAKKRNASGKIISLTVGVSVLLLLIMFCLWKRKQKRAKASAISIANTQRNQNLPMNEMVLSSKREFSGEYKFEELELPLIEMETVVKATENFSSCNKLGQGGFGIVYKGRLLDGKEIAVKRLSKTSVQGTDEFMNEVTLIARLQHINLVQVLGCCIEGDEKMLIYEYLENLSLDSYLFGKTRRSKLNWNERFDITNGVARGLLYLHQDSRFRIIHRDLKVSNILLDKNMIPKISDFGMARIFERDETEANTMKVVGTYGYMSPEYAMYGIFSEKSDVFSFGVIVLEIVSGKKNRGFYNLDYENDLLSYVWSRWKEGRALEIVDPVIVDSLSSQPSIFQPQEVLKCIQIGLLCVQELAEHRPAMSSVVWMFGSEATEIPQPKPPGYCVRRSPYELDPSSSWQCDENESWTVNQY

SEQ ID NO: 26162 - protein, 508 aa, Bos taurus
MSRFVQDLSKAMSQDGASQFQEVIRQELELSVKKELEKILTTAPSHEFEHTKKDLDGFRKLFHRFLQEKGPSVDWGKIQRPPEDSIQPYEKIKARGLPDNVSSVLNKLVVVKLNGGLGTSMGCKGPKSLIGVRNENTFLDLTVQQIEHLNKTYDTDVPLVLMNSFNTDEDTKKILQKYNHCRVKIYTFNQSRYPRINKESLLPVAKNVSYSGENTEAWYPPGHGDIYASFYNSGLLDTFIGEGKEYIFVSNIDNLGATVDLYILNHLMNPPNGKPCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 26163 - protein, 508 aa, Homo sapiens [sequence omitted]

SEQ ID NO: 26164 - protein, 332 aa, Gonyaulax polyedra
MAGPQLDDFTLVKVLGKGSYGKVMLVRGAQDNRLYAMKMLRKENVIKRNQVEHTKTERSVLETVSHPFIVTLHYAFQTPKKLYMVMEYCPGGELFFHLSRAGRFSEGRTRFYVAETSSAVAYLHQLNVIYRDLKPENLLIDGEGHAKITDFGLRKEGIQDNHSAMTMCGTPEYLAPEILDKKGHGKAVDWYSVGALTYEMLTGLPPFYTKDLQKLFDRIRRGELTYPDYVSVLAKEFLRALLQRNPDARLAGGVPGGDEVKGHEFFGGLDWVALEKRAIPPPFKPTFGGQKEDDVVKYFEKDFVGQPVVNSEVGEGGRDLGHLEASTLTGKR

SEQ ID NO: 26165 - protein, 63 aa, Stentor coeruleus
KWIHCFENVTAVLFVASLVGYAQVLREDDSQNCMRESLLLLQELCNSPWFRTSTFIIFLNKID

SEQ ID NO: 26166 - protein, 689 aa, Loligo pealei
MADLEAVLADVSYLMAMEKSKSSPAARASKKIVLPDPSIRSVMHKHLLKNGVVTFDHIFDQRIGFVLFKDYCNNGSDVPILEINFYEEIKKFQGMDKDEDRIKQARDIYDQFIMRELLAQCHDFTKTAVNNVQDALTKARKTKKLDVVVFNKYKEELRRKLNKEVFSKFIESDRYTRYLQWKNLELNINLTMNDFSVHRIIGRGGFGEVYGCRKADTGKMYAMKCLDKKRIKMKGGETLALNERIMLSLVSTGECPFIVCMTYAFQTPEKLCFILDLMNGGDLHYHLSQHGVFSEQEVKFYAAEVILGLEHMHVRGVVYRDLKPANILLDESGHVRISDLGLACDFSKKKPHASVGTHGYMAPEVLAKGVAYDSSADWFSFGCMLYKLLKGHSPFRQHKTKDKHEIDRMTMTMNVELPDSMSTEMKSLLEGLLKREVEERLGCKGKGAKELKEHEFFKDMDWNQVYQLRYPPPLIPPRGEVNAADAFDIGSFDEDDTKGIKLLDADQQLYENFTLTVSDRWQQEITETVFETVNNETDKLETKKKPKREEPCEKDVIVEGEILKLGGPFLNSWQKRHLRLYPNRLEFYQKNRDGGIQKNKVELITMYDLKEVCHEFQKLNKADNCIVMILKNETKLVITSQDKVLINQWKEEILGGFRASTKMQSKMNKKASKLYGADVPIEHRNSNGS

SEQ ID NO: 26167 - protein, 319 aa, Staphylococcus aureus
GLDGKNMILRSAILLTITVIFAISSYTGLKKGIQKLSDINVWLSFVLLAFIFIIGPTVFIMETTVTGFGNMLRDFFHMATWLEPFGGIKGRKETNFPQDWTIFYWSWWLVYAPFIGLFIARISKGRRLKEVVLGTIIYGTLGCVLFFGIFGNYAVYLQISGQFNVTQYLNTHGTEATIIEVVHHLPFPSLMIVLFLVSAFLFLATTFDSGSYILAAASQKKVVGEPLRANRLFWAFALCLLPFSLMLVGGERALEVLKTASILASVPLIVIFIFMMISFLIILGRDRIKLETRAEKLKEVERRSLRIVQVSEEEQDDNL

SEQ ID NO: 26168 - protein, 376 aa, Solanum dulcamara
MAIDCMITNGKSPMLDEKKTLIFDASHMKRESNIPTQFIWPDHEKPCAVAQQLAVPLIDLRGFLSGDSDAAQQASKLVGEACRSHGFFLVVNHGVEANLISNAHRYMDTFFDLPLSEKQKAQRKIGEHCGYASSFTGRFSSKLPWKETLSFRYSAEENSSHIVEEYFQRTLGESFNHLGNVYQEYCNSMNTLSLGIMELLGMSLGVEKSHFKEFFEENDSIMRLNYYPPCQKPELTLGTGPHCDPTSLTILHQDCVGGLQVFVDDEWRSITPTFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLQHNTTAQL

SEQ ID NO: 26169 - protein, 225 aa, Solanum dulcamara
LSFQYSDEEGSSHIVEDYFQRTMGEKFSHLGKVYQDYCNAMSTLSLRIMELLGLSLGVSRNHFKEFFQENESIMRLNYYPTCQKPELTLGTGPHCDPTSLTILHQDSVGGLQVFVDNEWHSITPNFNAFVVNIGDTFMALSNGRYKSCLHRAVVNNKIPRKSLAFFLCPKKDKVVTPPIELVDSNNPRIYPDFTWPDLLEFTQKQYRADMNTLQTFSIWLQKTQV

SEQ ID NO: 26170 - protein, 339 aa, Homarus americanus
MGCAMSNAADKEAAERSKKIDKDLRLAGERAAREVKLLLLGAGESGKSTIVKQMKIIHETGYSREECEQYRPVVYSNTIQSLMAIIRAMGQLKIDFRDSSRADDARHFFTLASAADEGELTPELANIMKRLWNESGVQHCFNRSREYQLNDTAAYYLNALDRIARPGYIPTQQDVLRTRVKTTGIVETNFSFKNLNFKLFDVGGQRSERKKWIHCFEGVTAIIFVVALSGYDLVLAEDEEMNRMIESMKLFDSICNNKWFVETSIILFLNKKDLFEQKITKSPLTICFPEYQGSNVYEDSANYIRMKFTCATDTNNIQFVFDAVTDVIIKNNLKDCGLF

SEQ ID NO: 26171 - protein, 110 aa, Ovis aries
HAGNKLAMQEFMILPVGASSFREAMRIGAEVYHHLKGVIKAKYGKDATNVGDEGGFAPNILENNEALELLKTAIQAAGYPDKVVIGMDVAASEFYRNGKYDLDFKSPDDP

SEQ ID NO: 26172 - protein, 1203 aa, Drosophila melanogaster
MNLARRACWRIKSYSSESLFKTYASVITDTSANEIDAEAPPPPRDKTKTRIEPQIAPAKRNSSCTSSDWRGMFSKRTLLICALALILGSAQARPNTSAVGVAPRKVSQDIVDAVTQLNLGQSAPIDAVDVGLDPTPSARVPRPEPLKSGDENAKGDEGHKMERYPLSSVDFARVKTPFIIGIWILSASIAKIGFHMTPKLHLIFPESCLLIVVGVVIGVVLYFCTDVAVSPLTPNTFFFYMLPPIILDAGYFMPNRLFFDNLGTILLMAVVGTIFNIATIGGSLYACGKMGIYGESETPGLMDVFLFASLISAVDPVAVLAVFEEIHVNEILYIVVFGESLLNDAVTVVVMYHMMESYNEIGLDKIIAQDIASGVGSFFVVALGGTAIGIIWGFLTGLVTRFTDHVRVIEPIFIFVMAYLAYLNAEIFHMSGILAITFCGITMKNYVESNISQKSHTTVKYALKMLSSSAETIIFMFLGVATVNNMHVWNTWFVVLTIAFCSVFRVIGVILLSALANRFRLHKLSRVDQFVMSYGGLRGAVAFALVLLVDENVVKQKNMFVTTTIAVIYFTVFLQGITIKPLVKILNVKRANKRKPTMNERIHERFMDHLMAGIEDIVGKTGNYNVRDKFKRFDNRFIRPLLIRDLKGAEPKIIETYSKLTMRDAMEVMRRNPSTIGQMTGTESMSALFRNYTNNYIGGSPSLTNLDNTCSRNLDMAELDYNPSKKDLTDARIHHLLAEELKPYRRHRRLSYSRHAVDDRDLSTQVQVNYKMQMNFRRMFNDRKHHKRSKRGASNKEAKENVKQNHVSFHDFQQNGTTKQLTNAEECQQNPNEINVVGPSDDWDDGLTFTAKSSLAEHPIPEEDRNLSRESDGERRVATPTATESQLPWKRQGDECTDAVQQNEFPAWASNKEYLAYNSPSATFLGGINKPKQPKSVIGLFRRESSSSKAGSVGVGSTGAMDSAASGSETMVVSMSSQPPNAPSTSIHNPRLDKRSQSISSSSLGAGAHQLGPEGHSGPFPVTASHRRNVRRGSMLELSGDTIPEESSYQHGHSKSLCEPADSDEWEGAPLSAAGGANSELLMRMSGREPLLPRPSNTPRAQIRRMNAGAVGGAGVSQAGRKNQVTKALLDYEDSETDSDENDDDEDEDFDSYDDENIVVTTFTTPATGRRPGSSPGSGSEANTATTTTTSIRLTRNNDESII

SEQ ID NO: 26173 - protein, 1192 aa, Caenorhabditis elegans
MSSASVGKKPEHVNTPPGDNQQKSSKENQKSNKDKQSSNQPPGQIPHSTNSGTRKSSGSGLKTANLKHPARPSTESSTSSSHHQRPAQEMNGTSTPTATGGGGTSGATTTASSGAPAASSGGSSARYSSSGRSHPTSGSSSSHARSTGQSGMSSRSAARRNDQDVHVGKYKLLKTIGKGNFAKVKLAKHVITGHEVAIKIIDKTALNPSSLQKLFREVKIMKQLDHPNIVKLYQVMETEQTLYLVLEYASGGEVFDYLVAHGRMKEKEARAKFRQIVSAVQYLHSKNIIHRDLKAENLLLDQDMNIKIADFGFSNTFSLGNKLDTFCGSPPYAAPELFSGKKYDGPEVDVWSLGVILYTLVSGSLPFDGQNLKELRERVLRGKYRIPFYMSTDCENLLKKFLVINPQRRSSLDNIMKDRWMNVGYEDDELKPFIEPPKDQIDEQRIEKLIQIFQLGFNKAAILESVEKEKFEDIHATYLLLGERKSDMDASEITMAQSLLSHSSINVSSSLGQHPAGVITREHVTSSSASGSSASPSRYSRSSATATGASITAGSALASAANAQKHQQSSAAPSSGSSSSRRSSQNDAAATAAGGTVVMSGTRHGGVQMRAQPTSRQATISLLQPPSYKPSSNTTQIAQIPPLFNRNSTATSSAAQPSTGITGTRKIADPKGRIPLNSTAVQGHRTATGAVAANNGGIPSHRDHAQQQQYMNQLTSSTMMSKLINKTPAAGGTAATSSSSSSSATSTAPLQKSGSQISHAPTEPVIREDDDENNSENQNGNVPLIGGVGPQTSPAVQVPTEDATSSSDKEQQQQKASSETPKESKPSMIHQSPSMPPSQMMTAMESLKLSESGQTGGPTVATGGPPQRATSQQMSRSATTNSANMGASSGGAAAAASATNQLSGAPSSTGASSQQYHPKAPSSSSSSSTNPPHQHQLTHNASFSVTPSSYQIPTSTAVNVTSTGMPTSSSSSAFPRNTRNRQTFHGKTEKDKGGDDSSDEIGETPGNVSIGATGPSANNAEATIWSKLSKLTRRDHNRESMTQPVSGRAGTIGASQGQQTAAALAAIREQSGPIAPGAGQVAPSLPIHEGDVKPRSLRFTWSMKTTSSLAPDDMMREIRKVLDANGCDYEQRERYMILCVYGDPNTDSLVQWEMEVCKLPRLSLNGVRFKRISGTSIGFKNIASKIAQELNL

SEQ ID NO: 26174 - protein, 197 aa, Caenorhabditis elegans
MTIEQTVFAKRRERCKCNPSDARIDILITMSAPVSDAPAAQIFYKIISNDGVVTKMSEKAVQQSKTLSNLIENLGYTIENIETRDPIPVTNVNGKTMEKVAEWCEKHNADAIPEDNMNVLKTLTIPEWDQKFLKIEDEALFDLILASNFLDIKGLMYYGCKTVSNMAKGKTTAELREIFGINTDEQDAAEGGAVEVA

SEQ ID NO: 26175 - protein, 564 aa, Mesembryanthemum crystallinum
MRERGMDSARSWLHKYQPRDKLRSSTKKKDSMMGGRDDSAPTSDEETPSNVTKQRVAAAKQYIEKHYKEQMKSLQERKERRSILERKLHDADVSEEDQNNLLKFLEKKETEYMRLQRHKMGADDFELLTMIGKGAFGEVRVCREKTTGHVYAMKKLKKSEMLRRGQVEHVKAERNLLAEVDSNCIVKLYCSFQDEEYLYLIMEYLPGGDMMTLLMRKDTLTEDEARFYVAETILAIESIHKHNYIHRDIKPDNLLLDKFGHLRLSDFGLCKPLDCSTLEEKDFEVNNGNGGSPSNEGSTKPRRTQQEQLQHWQKNRRMLAYSTVGTPDYIAPEVLLKKGYGMECDWWSLGAIMYEMLVGYPPFYSDDPMSTCRKIVNWRTHLKFPEEAKLSPEAKDLISKLLCNVTQRLGSNGAHEIKLHPWFNGIDWERIYQMEAAFIPEVNDELDTQNFEKFEEADNSSQSTSKAGPWRKMLSSKDLNFVGYTYKNFEIVNDYQVPGIAELKKKDTKPKRPSIKSLFEDESSDSSEAATSGDQSVQGSFLNLLPPQLEVSQTQTEVPPPKFT

SEQ ID NO: 26176 - protein, 370 aa, Oryza sativa; identical to SEQ ID NO: 3081

SEQ ID NO: 26177 - protein, 300 aa, Caenorhabditis elegans
MSKEKSFDTKKFLIDLASGGTAAAVSKTAVAPIERVKLLLQVQDASKAIAVDKRYKGIMDVLIRVPKEQGVAALWRGNLANVIRYFPTQAMNFAFKDTYKAIFLEGLDKKKDFWKFFAGNLASGGAAGATSLCFVYPLDFARTRLAADIGKANDREFKGLADCLIKIVKSDGPIGLYRGFFVSVQGIIIYRAAYFGMFDTAKMVFASDGQKLNFFAAWGIAQVVTVGSGILSYPWDTVRRRMMMQSGRKDILYKKHPRLRKEDHPNEGMSAMFKGALSNVFRGTGGALVLAIYDEIQKFL

SEQ ID NO: 26178 - protein, 169 aa, Pyrococcus furiosus
MDCGKDYCVKDLSLAEEGWKKIDWVSRFMPVLQYIKREFEEKKPFKGVRIAATLHLEMKTAFLLLTLKAGGAEVSAAASNPLSTQDDVVAALAKAGVKVYAIRGESREQYYEFMHKALDIRPNIIIDDGADMISLVHKERQEMLDEIWGGSEETTTGVIRLRAMEKAGI

SEQ ID NO: 26179 - protein, 575 aa, Sinapis alba
MSSCLLPNFKCQPDSFSVHFRTSYSVSKHSKGSAFFQPQCAVSTSPPLLTSTLDVAKLRLPSFDTDSDSRISDRPWTYTRTIGPSTEAKYLEALASETLLTSDEAVVAAAAAEAVALARAALKVAKDATLFGNSHNTKLSVSSAADKRSKWDQFTEKERAGILGHLAVSDTGVVSDRITAPGSLECNKEASDDLTPAEKQEVEKLSVSSAVRSTRQTERKARRVKGLEKTASGMQSSVKTGSSSRKKRVASQEIDHNDPLRYLRMTTSSSKLLTAREEQQLSEGIQDLLKLERLQAELTERCGHQPTFSQWASAAGVDKKTLRKRITHGTQCKDRMIKSNIRLVISIAKNYQGAGMDFQDLVQEGCRGLVRGAEKFDATKGFKFSTYAHWWIKQAVRKSLSDQSRMIRLPFHMVEATYRVKEARKQLYSETGKQPKNEEVAEATGLSMKRLMAVLLSPKPPRSLDQKIGINLNLKPSEVIADPEAETSEDILMKQFMRQDLDKVLDSLSTREKQVIRWRFGMEDGRMKTLQEIGETMGVSRERVRQIDTSAFRKLKNKKRNSHLQQYLVAQTKES

SEQ ID NO: 26180 - protein, 867 aa, Oryza sativa (japonica cultivar-group); identical to SEQ ID NO: 964

SEQ ID NO: 26181 - protein, 587 aa, Cucumis melo
MAKVADKPFFPKPFLVFFVLSIIFGFGITLSEAGFPKIRHYKWEVEYMFWSPDCVENIVMGINGQFPGPTIRANAGDMVVVELTNKLHTEGVVIHWHGILQRGTPWADGTASISQCAINPGETFTYRFVVDKAGTYFYHGHLGMQRSAGLYGSLIVDPQEGTSEPFHYDEEINLLLSDWWHQSVHKQEVGLSSKPMRWIGEPQSILINGRGQFDCSIAAKYKNGLKQCELSGKEQCAPFILHVHPKKIYRIRIASTTALASLNFAIGNHKLLVVEADGNYVQPFSTSDIDIYSGESYSVLITTDQNPSENYWVSIGVRARLPKTPPGLTVLNYLPNSVSKLPISPPPETPDWEDFDRSKNFTFRIFAAMGSPKPPVRYNRRLFLLNTQNRINGFMKWAINNVSLALPPTPYLAAMKFRLSTAFNQNPPPETFPIDYDINNPPRNPETATGNGVYKFNMGETVDVILQNANMLNANTSEIHPWHLHGHDFWVLGYGEGKFSAAEDGRKLNLKNPPLRNTVVIFPYGWTAIRFVADNPGVWAFHCHIEPHLHMGMGVIFAEGVHKVGMIPPNAMACGSTAMIKNYPRKP

SEQ ID NO: 26182 - protein, 175 aa, Hordeum vulgare subsp. vulgare
  unsure (1)..(175): unsure at all Xaa locations
MAAAGDAGEKKMITLKSSDGEEFEVEEAVAMESQTIRHMIEDDCADNGIPLPNVNSKILSKVIEYCNKHVQAKPADAGASSDTASAAXGAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 26183 - protein, 502 aa, Rattus norvegicus
MSCAGMDGAAASGSSSGSGGIFRSPAAKMLKVTVPSCPSSPCSSVTSSTENLVPDYWIDGSKRDPLSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRSCAYGPEVDMWSVGIITYILLCGFEPFYDERGDDFMFRRILNCEYYFISPWWDEVSLNAKDLVKKLIVLDPKKRLTTFQALQHPWVTGKAANFVHMDTAQKKLQEFNARRKLKAAVKAVVASSRLGSASSSHTNIQESNKASSEAQPAQDGKDKTDPLENKMQAGDHEAAKAAADETMKLQSEEVEEEEGVKEEEEEEEEEEETSRMVPQEPEDRLETDDQEMKRNSEETLKSVEEEMDPKAEEEAAAVGLGVPPQQDAILPEY

SEQ ID NO: 26184 - protein, 181 aa, Persea americana
VNMATGDHKKEPFISLNPFGQVPALEDGDLKLFESRAITNYISHEYAGKGTDLICKDSKKMAIVAVWMEVEAHHFDPEASKLVWELFYKPIYGLTTDPAAVTALSEKLAKVLDVYEGPLAHSKYLGGDCFHFADLHHLPCLNYLMTTQVKELFDSRLHVSAWCQDILARPAWAKVVEMQKK

SEQ ID NO: 26185 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTDLFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKESKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGLPKGMDPSQLIMEEKFGLTLQKEPPLYIVPKTRD

SEQ ID NO: 26186 - protein, 289 aa, Allium tuberosum
MPCSTVPFPTFPPPESESDESWVWNQIKAEARRDAESEPALASYLYSTIISHPSLARSLSFHLANKLCSSTLLSTSLYDLFLNALSTFPTILSATVADLIAARHRDPACIGFSHCLLNFKGFLAVQTQRIAHVLWSQSRRPLALALHSRVADVLSVDIHPAARIGKGILLDHATGVVIGETAVIGNNVSILHHVTLGGTGKAGGDRHPKIGDGVLIGAGATILGNIRIGAGAKIGAGSVVLIDVPPRTTAVGNPARLIGGKEKPSMHEDVPGESMDHTSFISEWSDYII

SEQ ID NO: 26187 - protein, 520 aa, Kluyveromyces lactis
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQFNETVWYIASSTLFVEHKLLLRFCYT

SEQ ID NO: 26188 - protein, 258 aa, Ralstonia eutropha
MLNGKTALVTGSTSGIGLGIAKALAAQGANIIVNGFGDADAAKAEIAQAGQGIRVGYHGADMSKAAEIEDMMRYAQSDFGGADILVNNAGIQHVAAIEDFPPERWDAIIAINLTSAFHTTRLALPGMKQKDWGRIINVASTHGLVASAQKSAYVAAKHGIVGFTKVTALETAQTGVTANAICPGWVLTPLVQKQVEARAQKEGIPVEQAKRELVLEKQPSGQFVTPDELGALAVFQSSEAARQVRGAIWNMDGGWVAQ

SEQ ID NO: 26189 - protein, 349 aa, Sinorhizobium meliloti
MSGATLEAYLASCTTHGDELSRDVAAVIQRLAKAALDIRKLVNQGALGTVFNGMHSGSNTDGDVQKDLDILCDDQFLSCLQGAPVACYASEELENPVLLDPAARLAVAIDPLDGSSNIDNNISIGTIFSVLPAAKGPDVDPSHSFLQPGNRQLAAGFFVYGPQTALVLSLGRGTDIFIFSSRLGCFVDAYKSVGIPDRANEFAINMSNYRHWEEAIRLYVDDCLAGSEGPRERDFNMRWIASLVAEAYRILVRGGIFLYPADSRKGYSHGRIRLVYEANPIAFIVENAGGSATTSVDRILDLVPESLHQRVPLVFGSRREVGRITRYHVDPNMIGERAPLFGKRGLFRA

SEQ ID NO: 26190 - protein, 224 aa, Triticum aestivum; identical to SEQ ID NO: 4572

SEQ ID NO: 26191 - protein, 221 aa, Zea mays; identical to SEQ ID NO: 5614

SEQ ID NO: 26192 - protein, 614 aa, Shewanella violacea
MEHTPQSQLKLLLAKGKEQGYLTYAEVNDHLPADMVDADQIEDIVQMINDMGIRVYEQAPDADEIMMTEDSTDDDAAEEAAAALATVEAELGRTTDPVRMYMREMGTVELLTREGEIVIAKRIEEGIYTVQASVAEYPPAIASILDQFDRYEAEEVRLSDIISGFIDPNAADIAPTATHIGSDLSQSERDKDDSKDDSKDDDEDEEEEGPKGPDPEESKERFTQLREVHENTLKIIADKGRGHPEATVALFEIGELFKEFRLMPKQFDRLVKNMRATMDKVRVQERLIMKLCVEQAKMPKKNFVKGYTADESSIAWFDTELASKKPYAEGLKMIEPDVRRCRFKLDIIEKETGLAIASIKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATGESLRNATHEVLAGLTAREAKVLRMRFGIDMNTDHTLEEVGKQFDVTRERIRQIEAKALRKLRHPSRSEILKSFLDE

SEQ ID NO: 26193 - protein, 335 aa, Oryctolagus cuniculus
MRILHVNGFNGEGGEEDAQAARSNSDGEKATKVQDIKNNLKEAIETIVAAMSNLVPPVDLANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRCLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 26194 - protein, 386 aa, Oryctolagus cuniculus
MEDEAQRGEGQGEANKKIEKQLQKDKQVYRATHRLLLLGAGESGKSTIVKQMRILHVNGFNGEGGEEDAQAARSNSDGEKATKVQDIKNNLKEAIETIVAAMSNLVPPVDLANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRCLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 26195 - protein, 302 aa, Xenopus laevis
MDEYTKIEKIGEGTYGVVYKGRHKATGQVVAMKKIRLENEEEGVPSTAIREISLLKELQHPNIVCLLDVLMQDSRLYLIFEFLSMDLKKYLDSIPSGQYIDTMLVKSYLYQILQGIVFCHSRRVLHRDLKPQNLLIDSKGVIKLADFGLARAFGIPVRVYTHEVVTLWYRAPEVLLGSVRYSTPVDVWSIGTIFAEIATKKPLFHGDSEIDQLFRIFRALGTPNNEVWPEVESLQDYKNSFPKWKGGSLSANVKNIDKDGLDLLTKMLIYDPAKRISARKALLHPYFDDLDKSSLPDNQIRN

SEQ ID NO: 26196 - protein, 423 aa, Trypanosoma brucei brucei
MDIVVNDDLSCRFLEGFNTRDALCKKISMNTCDEGDPFFVADLGDIVRKHETWKKCLPRVTPFYAVKCNDDWRVLGTLAALGTGFDCASNTEIQRVRGIGVPPEKIIYANPCKQISHIRYARDSGVDVMTFDCVDELEKVAKTHPKAKMVLRISTDDSLARCRLSVKFGAKVEDCRFILEQAKKLNIDVTGVSFHVGSGSTDASTFAQAISDSRFVFDMGTELGFNMHILDIGGGFPGTRDAPLKFEEIAGVINNALEKHFPPDLKLTIVAEPGRYYVASAFTLAVNVIAKKVTPGVQTDVGAHAESNAQSFMYYVNDGVYGSFNCILYDHAVVRPLPQREPIPNEKLYPSSVWGPTCDGLDQIVERYYLPEMQVGEWLLFEDMGAYTVVGTSSFNGFQSPTIYYVVSGLPDHVVRELKSQKS

SEQ ID NO: 26197 - protein, 198 aa, Vitis vinifera
MARASVLVVLVVVSVLLYTSRVAESAAANSGSTSFIKAKCSATRYPALCVQSLSVYASTIQKSPKQLAHTALTVSLAKAQSAKAFVSKLGKIKGMKARELEAVQDCLEEMNDSIDRLSRSVQELEEAGKSKGQDFLWHMSNVDTWVSAALTDDNTCVDGFAGRALDGRVKASIRGWLVTVAQVTSNALALVNQFAAKN

SEQ ID NO: 26198 - protein, 499 aa, Vitis vinifera
MELLSCLLCFLAAWTSIYIMFSARRGRKHAAHKLPPGPVPLPIIGSLLNLGNRPHESLANLAKTYGPIMTLKLGYVTTIVISSAPMAKEVLQKQDLSFCNRSIPDAIRAAKHNQLSMAWIPVSTTWRALRRTCNSHLFTSQKLDSNTHLRHQKVQELLANVEQSCQAGGPVDIGQEAFRTSLNLLSNTIFSVDLVDPISETAQEFKELVRGVMEEAGKPNLVYYFPVLRQIDPQGIRRRLTIYFGRMIEIFDRMIKQRLQLRKIQGSIASSDVLDVLLNISEDNSNEIERSHMEHLLLDLFAAGTDTTSSTLEWAMAELLHNPETLLKARMELLQTIGQDKQVKESDISRLPYLQAVVKETFRLHPAVPFLLPRRVEGDADIDGFAVPKNAQVLVNAWAIGRDPNTWENPNSFVPERFLGLDMDVKGQNFELIPFGAGRRICPGLPLAIRMVHLMLASLIHSYDWKLEDGVTPENMNMEERYGISLQKAQPLQALPVRV

SEQ ID NO: 26199 - protein, 319 aa, Aspergillus niger
MASPTVKLNSGYDMPLVGFGLWKVNNDTCADQIYHAIKEGYRLFDGACDYGNEVEAGQGIARAIKDGLVKREELFIVSKLWNSFHDGDRVEPICRKQLADWGIDYFDLYIVHFPISLKYVDPAVRYPPGWKSEKDELEFGNATIQETWTAMESLVDKKLARSIGISNFSAQLVMDLLRYARIRPATLQIEHHPYLTQTRLVEYAQKEGLTVTAYSSFGPLSFLELSVQNAVDSPPLFEHQLVKSIAEKHGRTPAQVLLRWATQRGIAVIPKSNNPQRLKQNLDVTGWNLEEEEIKAISGLDRGLRFNDPLGYGLYAPIF

SEQ ID NO: 26200 - protein, 739 aa, Mangifera indica
MESCNCIEPQWPADELLMKYQYISDFFIALAYFSIPLELIYFVKKSAVFPYRWVLVQFGAFIVLCGATHLINLWTFSMHSRTVAIVMTTAKVFTAAVSCATALMLVHIIPDLLSVKTRELFLKNKAAELDREMGLIRTHEETGRHVRMLTHEIRSTLDRHTILKTTLVELGRTLALEECALWMPTQTGLELQLSYTLHQQNPVGYTVPIQLPVISQVFTSNHAVKISPNCPVARLRPLAGKYMPGEVVAVRVPLLHLLNFQINDWPELSTKRYALMVLMLPSDSARQWHVHELELVEVVADQVAVALSHAAILEESMRARDLLVVQNIALDRARREAETAICARNDFLSVMNHEMRTPMHAIIALSSLLQETELTPEQRLMVETILKSGNLLATLINDVLDLSRLEDGSLQLQLGTFNLHAVFKEVLNLIKPIASVKKLLVALNLAPDLPEYAVGDEKRFMQTLLNVVGNAVKFTKEGNILITAFVAKSESFLDSRTPEFFPVPSDNHFYLRVQVKDSGSGISPQDIPKLFTKFAQNQSIATRNSHGSGLGLAICKRFVNLMEGHIWIESEGLGKGCTAVFVVKLGIPESSNESKLSFMPKMSGPQTNFTGLKVLVLDDNGVSRSVTKGLLVHPGCDVMTVGSSEECLHVVSQEHKVVFMDVGIPGIDGYEVAVHIHQKFTRRHERPLIVALTGNTDKITKENCMSVGMDGVILKPISLEKMRSVLLGLLEHRVLFEAI

SEQ ID NO: 26201 - protein, 109 aa, Agaricus bisporus
KNEQQAQQPPQGGYYPPPQGPPPGQGYYPQQPPQSYQQGGYYQGPPQGPPQPGYGPPQPGYGPQPGGPQTVYVQEQKGSGSGAASGGCMACLAALCVCCCAEEICDCIF

SEQ ID NO: 26202 - protein, 207 aa, Mus musculus
MTMDGDSSTTDASQLGISADYIGGSHYVIQPHDDTEDSMNDHEDRNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVSATDGLSEELTEEAFTNQLPAGLITADGQQQNVMVYTTSYQQISGVQQIQFS

SEQ ID NO: 26203 - protein, 420 aa, Gnetum parvifolium
MDPDSFSAAFFKWEQRSPIPLQMQRAGNVFHDFSVPSPTVGVPPIMANTSNVCISNRKEMICLEELFRHYGVRYITMTKMMEMGFTVNTLVNMTEQELDEAIRTLVEIYRMELLVGEKYGIKSAIRAERRRLDEAEKKRLQDLFSDVDGKRKIDENALDTLSQEGLSVEEPHGDNTMLLSQNNTASSFPLNLNAGTDPVLILQNGARMGSTVGAFMGLPADNNMGDSHGHGHGNNGNGKASKKQKRRRPRESGEEGGDRQREHPFIVTEPGELARGKKNGLDYLFDLYEQCGKFLSEVQQIAKERGEKCPTKVTNQVFRHAKYSGASYINKPKMRHYVHCYALHCLDVEQSNRLRKAYKERGENVGAWRQACYYPLVAKARESDWDIDGVFNKHEKLRIWYVPTKLRQLCHLEKSKQCHL

SEQ ID NO: 26204 - protein, 272 aa, Physcomitrella patens
QVQCGNFLARQCWGSPGYSGIILRQQPDLSEVQGVFNPSTARLDMASNVGRRGYSRGGSNVVPVRNDSSTDTLVAMLASCSPVALQVQRTGGSLEDAVVSCGQKRSFFPLFEASREDAGDEDLGDDCTHNVEKKRRLTFDQVRSLELNFEVENKLEPERKMQLAKELGLQPRQVAVWFQNRRARWKTKQLERDYEVLTLDYNRLKSEFEAVLQEKQELQGEMECLTGRLQTSPQLASGDGVSEKPSKKSSKAVASQLSLQKMVSEECVEVRE

SEQ ID NO: 26205 - protein, 173 aa, Physcomitrella patens
IVQDYSSGNMGSCDCEESSLSSILTLQDQREMFRSVFPGRSSDNSQEYDEDDEGSSQKLRFTKAQLRVLEDTFERLQRPNAHQKSTLAMELGVQPRQVEVWFQNRRARGKAKRNESDCEVLRQRCQDLLVENHHLSYLIQTERMGYDSRQLSNEGGPLLQMALCNNCKKLRNC

SEQ ID NO: 26206 - protein, 160 aa, Physcomitrella patens
MSSRGGSDDEDEGTTRKKLRLSKEQSALLEESFKEHSTLNPKQKNALAKQLGLRPRQVEVWFQNRRARTKLKQTEVDCELLKRCYESLKEENRRLQKELLELRAIKVAPPCVISHDYYMPLPAATLTMCPSCERVATVDNRSLTFAKPGFSHLSQSSAAC

SEQ ID NO: 26207 - protein, 345 aa, Physcomitrella patens
MAITSMGGYPCQSAMQQLIRNESSSDSLAAILTPCSPHVGLQAPPHVGGSLEDAVLVASEGSRQKRPFFATYDAPTVEDGSVEDDEGADDSQGASQLEKKRRLTFDQVRSLERNFEMENKLEPERKMQLAKELGLRPRQVAVWFQNRRARWKTKQLERDYEALAADYKSLKHDYDLVLAEKNNLKAEVQRLSGKAPTSPCADGNQIVAGESAQTPEVDVETSELVARQHTSRSTPTVDVSLACVKDKDFETSGCTDGNSSDVLDADSPRTTDSSSLSAMSDHDQLIYSHEIPPPESFMGLSGMLHDVTVKLEEGSGHGFHDDNSSNYFLLHLEDQAGVLPWWDWP

SEQ ID NO: 26208 - protein, 296 aa, Physcomitrella patens
MAALGRAGETMSMTAVSSSGGGLEEEATGRGQKRPHHPISDKGPGEEPEEGDDCCYDGAHPMEKKRHLSFEQVRSLERNFEMEIKLEPDRKMKLAKELGLQPRQIAVWFQNRRARWKTKQLERDFELLNSGYSKLKRDFEKVLEEKDVLKAELVRLSAKIIPKDSQSVDFSQSEKDSHCKPTANDPAKSDKLKESKPATPKDNQSTRSSPTTVVCSATTLEAEITSTSSGSNSSDLLDADSPRTTDSNPREEQLANYCGQLLPENFVGHLTVEEAVNTSQKVYSVKLEDGLPSLPS

SEQ ID NO: 26209 - protein, 206 aa, Escherichia coli O157:H7
MAIPAFGLGTFRLKDDVVISSVKTALELGYRAIDTAQIYDNEAAVGLAIAESGVPRHELYITTKIWIENLSKDKLIPSLKESLQKLRTDYVDLTLIHWPSPNDEVSVEEFMQALLEAKKEGLTREIGISNFTIPLMEKAIAAVGAENIATNQIELSPYLQNRKVVAWAKQHGIHITSYMTLAYGKALKDEVIARIAAKHNATPAQV

SEQ ID NO: 26210 - protein, 502 aa, Candida glabrata
MSTAKKHTKTHSTYAFESNTNSVAASQMRNALNKLADSIGSEHGDDARTRFENELDSFFTLFRRYLVEKSSSNTLEWDKIKSPNPEEVVRYDTINSQAENVSSLSKLAVLKLNGGLGTSMGCVGPKSVIEVREGNSFLDLSVRQIEHLNRQYDSDVPLLLMNSFNTDKDTEHLIKKYSANRIRIRSFNQSRFPRVYKDSMLPVPETYNDPKDAWYPPGHGDLFESLHASGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLVESSALEMEIIPNQKTITRGGQEINVLQLETACGAAIRHLSGAHGVVVPRSRFLPVKTCSDLLLVKSDLFYLQHGALKLDPSRFGPNPLIKLGSHFKKVSDFSARIPHIPKLVELDHLTITGNVFLGKGVTLRGTVIIVCSDGQKIDIPNGSVLENVVITGNLQILEH

SEQ ID NO: 26211 - protein, 357 aa, Halocynthia roretzi
MGCAPSKSENDKDAVSKSKEIDKQLKKDAENARKEVKLLLLGAGESGKSTIAKQMKILHQDGFSEEERKNFAPVVYTNTIQSMVAIVKAMESLGIDYEDNEREEDGRKIRAASQTMEEIDITADIGAALKRLWMDKGVQACVARSREYQLNDSATYYLDALDRLCSPDYIPTEQDVLRTRVKTTGIIETTFQYKNLNFTLIDVGGQRSERKKWIHCFQDVTAIIFCVAMSAYDQVLAEDEETNRMIESLKLFQSICNNPFFAKTSMILFLNKKDLFEEKIKKSPLNTCFKEYEGENSYADASEHIKEQFEAANKNNCMKEIYTHFTCATDTGNVRFVFDAVSDVLMRKIIDNVFGSG

SEQ ID NO: 26212 - protein, 354 aa, Octopus vulgaris
MGCAVSSVDKAGAERSKAIDKSLRAEGERSAREVKLLLLGAGESGKSTIVKQMKIIHEKGYTQEECLQYKPVVYSNIMQSMMAIIRAMGLLKINFGSSEGENDAKTLFEISQNSDECDMTPELSALYMRLWSDPGVMSCVARSREYQLNDSAQYYLHALERISQPYYIPNVQDVLRTRVKTTGIVETHFTFKELRFKMFDVGGQRSERKKWIHCFEGVTAIIFIVAMSEYDLMLAEDQEMNRMMESMKLFDSICNNKWFLDTSIMLFLNKKDLFEDKIKNSPLTTCFPEYEGGNTYEESAAYIQLQFENLNKRKEEKEIYTHFTCATDTNNVQFVFDVVTDVIIKNNLKDCGLF

SEQ ID NO: 26213 - protein, 354 aa, Octopus vulgaris
MGCTMSAEERLALERSKAIEKNLKEDGIQAAKDIKLLLLGAGESGKSTIVKQMKIIHEGGFTSEDNKQYKPVVYSNTIQSLVAIIRAMGTLDIPFGDNERECDAKMVLDVIGRMEDTEPFSDELLQAMKRLWADTGVQECFGRSNEYQLNDSAKYFLDDLDRLGAKDYMPTVQDILRTRVKTTGIVEVHFAFKTLNFKLFDVGGQRSERKKWIHCFEDVTAIIFCVAMSEYDQVLHEDETTNRMQESLKLFDSICNNKWFTDTSIILFLNKKDLFEEKIKKSPLTICFPEYTGRQTYEEAAAYIQAQFEAKNKSATKEIYCHQTCATDTNNIQFVFDAVTDVIIANNLRGCGLY

SEQ ID NO: 26214 - protein, 353 aa, Octopus vulgaris
MACCLSEEAKEQKRINQEIERQLRRDKRDARRELKLLLLGTGESGKSTFIKQMRIIHGAGYSEEDRKGFEKIVYQNIFSAIQTLIAAMETLSLEYKTSGNNENAEFIDSIDADSADTFDQSHVDAIKSLWTDEGMQECYDRRREYQLTDSAKYYLDDTERLHEPGHSPTLQDILRVRVPTTGIIEYPPDLDSTILRMADVGGQRSERRKWIHCFENVTSIMFLVALSEYDQVLVESDNENRMEESKALFRTIITYPWFQNSSVILFLNKKDLLEEKIMTSHLADYFPDYDGPKKDAQAAREFILRMFVDLNPDPDKIIYSHFTCATDTENIRFVFAAVKDTILQLNLKEYNLV

SEQ ID NO: 26215 - protein, 377 aa, Octopus vulgaris
MGCFRRTREDEDDKLRKEQNKKIEKQLQKDKQVYRSTHRLLLLGAGESGKSTIVKQMRILHVDGGFGPEERKLKIEDIKRNIRDAILTITGAMSTLNPPVELDDSSLMHHVNYIQEIASQQDFDYPAEFYEHTEILWRDKGVQTCYERSNEYQLIDCAQYFLDRVHIVKSADYTPTEQDILRCRVLTSGIFETRFIVDKVNFHMFDVGGQRDERRKWIQCFNDVTAIIFVTACSSYNLVLREDNTQNRLKESLELFQSIWNNRWLRSISVILFLNKQDLLAEKVKAGKSKIETYFADFERYVTPVDAHTEPGDDPEVVRAKYFIRDEFLRISTATRDGRHYCYPHFTCAVDTENIRRVFNDCRDIIQRMHLRQYELL

SEQ ID NO: 26216 - protein, 250 aa, Bacillus sp. 240B1
MTVKKLYFVPAGRCMLDHSSVNSTLTPGELLDLPVWCYLLETEEGPILVDTGMPESAVNNEGLFNGTFVEGQVLPKMTEEDRIVNILKRVGYEPEDLLYIISSHLHFDHAGGNGAFINTPIIVQRAEYEAAQHSEEYLKECILPNLNYKIIEGDYEVVPGVQLLHTPGHTPGHQSLLIETEKSGPVLLTIDASYTKENFENEVPFAGFDSELALSSIKRLKEVVMKEKPIVFFGHDIEQERGCKVFPEYI

SEQ ID NO: 26217 - protein, 810 aa, Homo sapiens
DPPRMSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSITMKDEDLINKCGDDARIYIVFQYHLIIFVLIICIPSLGIILPINYTGSVLDWSSHFARTTIVNVSTESKLLWLHSLLSFFYFITNFMFMAHHCLGFAPRNSQKVTRTLMITYVPKDIEDPELIIKHFHEAYPGSVVTRVHFCYDVRNLIDLDDQRRHAMRGRLFYTAKAKKTGKVMIRIHPCARLCFCKCWTCFKEVDAEQYYSELEEQLTDEFNAELNRVPLKRLDLIFVTFQDSRMAKRVRKDYKYVQCGVQPQQSSVTTIVKSYYWRVTMAPHPKDIIWKHLSVRRFFWWARFIAINTFLFFLFFFLTTPAIIMNTIDMYNVTRPIEKLQNPIVTQFFPSVMLWGFTVILPLIVYFSAFLEAHWTRSSQNLVMVHKCYIFLVFMVVILPSMGLTSLDVFLRWLFDIYYLEQASIRFQCVFLPDNGAFFVNYVITAALLGTGMELLRLGSLFCYSTRLFFSRSEPERVNIRKNQAIDFQFGREYAWMMNVFSVVMAYSITCPIIVPFGLLYLCMKHLTDRYNMYYSFAPTKLNEQIHMAAVSQAIFAPLLGLFWMLFFSILRLGSLHAITIFSLSTLLIAMVIAFVGIFLGKLRMVADYEPEEEEIQTVFDMEPSSTSSTPTSLLYVATVLQEPELNLTPASSPARHTYGTMNNQPEEGEEESGLRGFARELDSAQFQEGLELEGQNQYH

SEQ ID NO: 26218 - protein, 763 aa, Zea mays
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYVPGRDHRARRVWLPHRPLPGRQGVGPARGLLRQVPGGRATGARSPRAGSSVSRRSTPGSCTRRG

SEQ ID NO: 26219 - protein, 2474 aa, Saccharomyces cerevisiae
MNKYINKYTTPPNLLSLRQRAEGKHRTRKKLTHKSHSHDDEMSTTSNTDSNHNGPNDSGRVITGSAGHIGKISFVDSELDTTFSTLNLIFDKLKSDVPQERASGANELSTTLTSLAREVSAEQFQRFSNSLNNKIFELIHGFTSSEKIGGILAVDTLISFYLSTEELPNQTSRLANYLRVLIPSSDIEVMRLAANTLGRLTVPGGTLTSDFVEFEVRTCIDWLTLTADNNSSSSKLEYRRHAALLIIKALADNSPYLLYPYVNSILDNIWVPLRDAKLIIRLDAAVALGKCLTIIQDRDPALGKQWFQRLFQGCTHGLSLNTNDSVHATLLVFRELLSLKAPYLRDKYDDIYKSTMKYKEYKFDVIRREVYAILPLLAAFDPAIFTKKYLDRIMVHYLRYLKNIDMNAANNSDKPFILVSIGDIAFEVGSSISPYMTLILDNIREGLRTKFKVRKQFEKDLFYCIGKLACALGPAFAKHLNKDLLNLMLNCPMSDHMQETLMILNEKIPSLESTVNSRILNLLSISLSGEKFIQSNQYDFNNQFSIEKARKSRNQSFMKKTGESNDDITDAQILIQCFKMLQLIHHQYSLTEFVRLITISYIEHEDSSVRKLAALTSCDLFIKDDICKQTSVHALHSVSEVLSKLLMIAITDPVAEIRLEILQHLGSNFDPQLAQPDNLRLLFMALNDEIFGIQLEAIKIIGRLSSVNPAYVVPSLRKTLLELLTQLKFSNMPKKKEESATLLCTLINSSDEVAKPYIDPILDVILPKCQDASSAVASTALKVLGELSVVGGKEMTRYLKELMPLIINTFQDQSNSFKRDAALTTLGQLAASSGYVVGPLLDYPELLGILINILKTENNPHIRRGTVRLIGILGALDPYKHREIEVTSNSKSSVEQNAPSIDIALLMQGVSPSNDEYYPTVVIHNLMKILNDPSLSIHHTAAIQAIMHIFQNLGLRCVSFLDQIIPGIILVMRSCPPSQLDFYFQQLGSLISIVKQHIRPHVEKIYGVIREFFPIIKLQITIISVIESISKALEGEFKRFVPETLTFFLDILENDQSNKRIVPIRILKSLVTFGPNLEDYSHLIMPIVVRMTEYSAGSLKKISIITLGRLAKNINLSEMSSRIVQALVRILNNGDRELTKATMNTLSLLLLQLGTDFVVFVPVINKALLRNRIQHSVYDQLVNKLLNNECLPTNIIFDKENEVPERKNYEDEMQVTKLPVNQNILKNAWYCSQQKTKEDWQEWIRRLSIQLLKESPSACLRSCSSLVSVYYPLARELFNASFSSCWVELQTSYQEDLIQALCKALSSSENPPEIYQMLLNLVEFMEHDDKPLPIPIHTLGKYAQKCHAFAKALHYKEVEFLEEPKNSTIEALISINNQLHQTDSAIGILKHAQQHNELQLKETWYEKLQRWEDALAAYNEKEAAGEDSVEVMMGKLRSLYALGEWEELSKLASEKWGTAKPEVKKAMAPLAAGAAWGLEQWDEIAQYTSVMKSQSPDKEFYDAILCLHRNNFKKAEVHIFNARDLLVTELSALVNESYNRAYNVVVRAQIIAELEEIIKYKKLPQNSDKRLTMRETWNTRLLGCQKNIDVWQRILRVRSLVIKPKEDAQVRIKFANLCRKSGRMALAKKVLNTLLEETDDPDHPNTAKASPPVVYAQLKYLWATGLQDEALKQLINFTSRMAHDLGLDPNNMIAQSVPQQSKRVPRHVEDYTKLLARCFLKQGEWRVCLQPKWRLSNPDSILGSYLLATHFDNTWYKAWHNWALANFEVISMLTSVSKKKQEGSDASSVTDINEFDNGMIGVNTFDAKEVHYSSNLIHRHVIPAIKGFFHSISLSESSSLQDALRLLTLWFTFGGIPEATQAMHEGFNLIQIGTWLEVLPQLISRIHQPNQIVSRSLLSLLSDLGKAHPQALVYPLMVAIKSESLSRQKAALSIIEKMRIHSPVLVDQAELVSHELIRMAVLWHEQWYEGLDDASRQFFGEHNTEKMFAALEPLYEMLKRGPETLREISFQNSFGRDLNDAYEWLMNYKKSKDVSNLNQAWDIYYNVFRKIGKQLPQLQTLELQHVSPKLLSAHDLELAVPGTRASGGKPIVKISKFEPVFSVISSKQRPRKFCIKGSDGKDYKYVLKGHEDIRQDSLVMQLFGLVNTLLQNDAECFRRHLDIQQYPAIPLSPKSGLLGWVPNSDTFHVLIREHREAKKIPLNIEHWVMLQMAPDYDNLTLLQKVEVFTYALNNTEGQDLYKVLWLKSRSSETWLERRTTYTRSLAVMSMTGYILGLGDRHPSNLMLDRITGKVIHIDFGDCFEAAILREKFPEKVPFRLTRMLTYAMEVSGIEGSFRITCENVMKVLRDNKGSLMAILEAFAFDPLINWGFDLPTKKIEEETGTQLPVMNANELLSNGAITEEEVQRVENEHKNAIRNARAMLVLKRITDKLTGNDIRRFNDLDVPEQVDKLIQQATSVENLCQHYIGWCPFW

SEQ ID NO: 26220 - protein, 444 aa, Stylonychia lemnae
MSFGSQKSLISSSLDLYQLAQYFIARLEPILHNTLLIGIINPRLRRIRDHCSKGRRLKNSRSSKRFFEPTSPVDIPDAKDPQKCAEYACDIFDFLIQTETENIANPGYMEKQEDINEKMRAILIDWLVEVHLKFKLVPESLYLTVNLIDRYLEKIASKQTETLISRSYSYAIARNQRDISHVDRSIRYTKEEILSMEREMLQALDFNIQITSSYRFLERFSKVAKTDPLIFNLSRYLLELALVNYKLLKYSPSNLASSALFLSLKMTKHPSAMDSLRLRVLLVIMLQIVTVATAASCVHVAEANAGAILVDYCVEIVIEMMKDVVMVATATTLGSSLILDTSLNLGKANFFFTATVSLTIVLIVFRRVLFDVPDCLFLVVCVFYHTSVHGGGVVNTVQGNISQYGTTAPIILAAAAIKPLPAVTNRDGGRFECQCSRLITFNFE

SEQ ID NO: 26221 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDIPSVVEKYMNKELELEKFITHTLPFAEINKAFDLMLKGEGLRCIITMED

SEQ ID NO: 26222 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFELAKNFGVTEFVNPKDHKKPVQEVIAEMTGGGVDRSVECTGSIQAMISAFECVHDGWGVAVLVGVPNKDDAFKTHPVNLLNERTLKGTFFGNYKPRTDIPAVVERYMNKELELDKFITHSVPFSEINKAFEYMLAGEGLRCVIRMVA

SEQ ID NO: 26223 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRTVQCTGSIQAMISAFECVHDGWGVAVLVGVPNKDDAFKTHPVNLLNERTLKGTFFGNYKPRSDIPAVVEKYMNKELELDKFITHTVPFSEINKAFELMLAGEGLRCCIRMDA

SEQ ID NO: 26224 - protein, 487 aa, Vigna radiata
MRRGLDNQAYYVLGHKTPNIRDLYTLGRKLGQGQFGTTYLCTENSTSNEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQIFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRAIDPAVLSRLKQFSAMNKLKKMALRVIAESLSEEEIAGLREMFQAMDTDNSGAITFDELKAGLRRYGSTLKDVEIRDLMEAADVDKSGTIDYGEFIAATVHLNKLEREEHLIAAFQYFDKDGSGYITVDELQQACAEHNMTDAFLEDIIREVDQDNDGRIDYGEFAAMMQKGNAGIGRRTMRNSLNLSMRDASSAQ

SEQ ID NO: 26225 - protein, 516 aa, Drosophila melanogaster
MAAPAACTRFSDNYDIKEELGKGAFSIVKRCVQKSTGFEFAAKIINTKKLTARDFQKLEREARICRKLHHPNIVRLHDSIQEENYHYLVFDLVTGGELFEDIVAREFYSEADASHCIQQILESVNHCHQNGVVHRDLKPENLLLASKAKGAAVKLADFGLAIEVQGDHQAWFGFAGTPGYLSPEVLKKEPYGKSVDIWACGVILYILLVGYPPFWDEDQHRLYSQIKAGAYDYPSPEWDTVTPEAKNLINQMLTVNPNKRITAAEALKHPWICQRERVASVVHRQETVDCLKKFNARRKLKGAILTTMLATRNFSSRSMITKKGEGSQVKESTDSSSTTLEDDDIKEDKKGTVDRSTTVVSKEPEVNLFTNKAARRQEIIKITEQLIEAINSGDFDGYTKICDPHLTAFEPEALGNLVEGIDFHKFYFENVLGKNCKAINTTILNPHVHLLGEEAACIAYVRLTQYIDKQGHAHTHQSEETRVWHKRDNKWQNVHFHRSASAKISGATTFDFIPQK

SEQ ID NO: 26226 - protein, 826 aa, Zea mays; identical to SEQ ID NO: 6035

SEQ ID NO: 26227 - protein, 337 aa, Sus scrofa domestica
TDQAAFDTNIVTLTRFVMEEGRKARGTGEMTQLLNSLCTAVKAISTAVRKAGIAHLYGIAGSTNVTGDQVKKLDVLSNDLVINVLKSSFATCVLVSEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRDVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 26228 - protein, 476 aa, Hordeum vulgare
MRTTTRRLPPAPAAAAVLLAALTCLLLRPAAVAAAGGHAADRIVRLPGQPEVDFDMYSGYITVDEAAGRSLFYLLQEAPEEAQPAPLVLWLNGGPGCSSVAYGASEELGAFRVMPRGAGLVLNEYRWNKVANVLFLDSPAGVGFSYTNTSSDIYTSGDNRTAHDSYAFLAAWFERFPHYKYREFYVAGESYAGHYVPELSQLVHRSGNPVINLKGFMVGNGLIDDYHDYVGTFEFWWNHGIVSDDTYRRLKDACLHDSFIHPSPACDAATDVATAEQGNIDMYSLYTPVCNISSSSSSSSLSRRRTRGRYPWLTGSYDPCTERYSTAYYNRRDVQTALHANVTGAMNYTWATCSDTINTHWHDAPRSMLPIYRELIAAGLRIWVFSGDTDAVVPLTATRYSIGALGLATTTSWYPWYDDLQEVGGWSQVYKGLTLVSVRGAGHEVPLHRPRQALILFQQFLQGKPMPGRTTNVTVA

SEQ ID NO: 26229 - protein, 471 aa, Aspergillus niger
FEFLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINAKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGAAYRQLEFLLGRIDSLSAKGDYTS

SEQ ID NO: 26230 - protein, 477 aa, Helianthus tuberosus
HEWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSASGKEFREVITNIMVDSAKTNLVDVFPVLKRIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 26231 - protein, 505 aa, Helianthus tuberosus
MEIPYLLTTTLLLLFTTLYLLLRRRSSTLPPTIFPSLPIIGHLYLLKPPLYRTLAKLSAKHGQILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 26232 - protein, 509 aa, Nicotiana tabacum
MEGTNLTTYAAVFLGTLFLLFLSKLLRQRKLNLPPGPKPWPIIGNLNLIGNLPYRSIHELSLKYGPVMQLQFGSFPVVVGSSVEMAKIFLKSMDINFVGRPKTAAGKYTTYNYSDITWSPYGPYWRQARRMCLTELFSTKCLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMEDVLLQLADDPKLEVKLERHGVKAFTQDMLAGGTESSAVTVEWAISELSKKPEIFKKATEELDRVIGQNRWVQEKDIPNLPYIEAIVKETMRLHPVAPMKATECRENSKVAGYDVQKGTRVLVSVWTIGRDPTLWDEPEVFKPERFHEKASIDVKGHDYELLPFGVGRRMCPGYSLGLKVIQASLANLLHGFNWSLPDNMTPEDLNMDEIFGLSTPKKFPLATVIEPRLSPKLYSV

SEQ ID NO: 26233 - protein, 498 aa, Nicotiana tabacum
METPTWTAYAAACLATLSLFLLSKFLRQRKLNLPPGPKPWPIVGNFNLIAPLAHRSVHELSLKYGPIMQLRFGSFPVVVGSSVEMAKVFLKSMDINFVDRPKMAAGKYTTYNYSNITWSAYGPYWRQARKMCLMELFTAKRLESLEYIRTEELQSLLHDLYNLTGKPILLKDYLMTLSLNVISRMVLGKRYLDESKNSIVTPEEFKKMLDELFLLNGVLNIGDYIPWIDFMDLQGYVKRMKVLSNKFDRFLEYVLDEHNARRNAEENYVAKDMVDVLLQFADDPTLEVKLERHGVKAFTQDLLAGGTESTAVIVEWAISELLKKPEIFNKATEELDRVIGQNRWVQEKDIPNFPYIEAIVKETMRLHPVAPMLTPRLCGEDCKVAGYDILKGTRVLVSVWTIARDPTLWDEPEAFKPERFLGNSIDVKGHNFELLPFGAGRRMCPGYNLGLKVIQASLANLLHGFKWSLPDNMTPEDLNMEEIFCLSIPKKIPLAACD

SEQ ID NO: 26234 - protein, 112 aa, Oryza sativa; identical to SEQ ID NO: 3874

SEQ ID NO: 26235 - protein, 182 aa, Cucumis sativus
MAAGSVAFVLGLIAVVFLHPATAQSTVHIVGDNTGWSVPSSPNFYSQWAAGKTFRVGDSLQFNFPANAHNVHEMETKQSFDACNFVNSDNDVERTSPVIERLDELGMHYFVCTVGTHCSNGQKLSINVVAANATVSMPPPSSSPPSSSPPSSVMPPPSPSSSNALMATLYLTFSALLVMAFF

SEQ ID NO: 26236 - protein, 181 aa, Gossypium hirsutum
GIFGLGAVRPAAAEGASIAGASRIIGVDLNPNRFEEAKKFGCTEFVNPKDHNKPVQEVLAEMTNGGVDRSVECTGNINAMISAFECVHDGWGVAVLVGVPNRDDAFKTHPVNFLNERTLKGTFFGNYKPRSDLPSVVEKYMNKELELEKFITQQVAFRDINKAFDYMLAGEGIRCIIRMDA

SEQ ID NO: 26237 - protein, 379 aa, Zea mays
MATAGKVIKCRGCRDVGGRQTAVHRGGGGSAAAGHGGAYQDPLHRALPHRRLLLGGQGANPGVPEDLRTRSGRIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 26238 - protein, 377 aa, Solanum tuberosum
MDSSNPKVITCKAAVVGKEGEMIKIEEIQVDPPKSNEVRIKMLFASLCHTDILASNGYPYSLFPRVLGHEGVGMIESVGENVTNLKEGDIVMPLYLGECKECPNCKSGKSNLCHKYHLTFSGLMLDDTSRISIHGGQVLYHSFSCSTWSEYIVINANYVIKVDPQKIPLQHASLLCCGFTTGYGATWREVHVEKGSTVAVLGLGVVGLGAIEGARSQGASKIIGVDINESKQGKGELFGMTDFINPKESMTSVSEMIKDVTEGLGVDYVFECTGIPSMLNEAIEASKLGIGTIVVIGAGHGLTREFNLVPLLCGRTLKGSIYGGIRLHSDLPAILHRCATKEIQLNELITHQISLTEINQSFELLKDPHCVKIIIKF

SEQ ID NO: 26239 - protein, 422 aa, Linum usitatissimum
MASLPVSFAKPDKNGVITCKAIMLKEAKLPGMSYADTVQIIDIQVDPPQNVELRVKMLCASVCRTDILTIEGFMAPTQFPKINGHEGVGIIESMGPDTKNFKVGDVIVAPTLGECQTCSSCRSGRTNFCQNYGANESALEPDGTSRFSYIDSDGKKKLLYYKLGCSTWTQYMVVDSNYATKLNEIAPELPPPHGSILSCAFATGYGAVWLDAAVQEGDSVAIFGVGSVGISAVIAAKELKAKQIIVVDRNEYKLKMAMELGATHCINSEKLPEGVTPSQAVRKLTPKEVGVDASIESSGYDVFMNEAMKAAIHGKAKTVITGEGIYENDRIFFDFKDFLFGGNVVGNVTGRVRIHSDFPGLLRKAQEPVIRAGMDKILGYDAATMKCKYEVDIREGTPALLKALEEVENVDCVKLVIKLNDY

SEQ ID NO: 26240 - protein, 293 aa, Hordeum vulgare
MASQKFPPQQQDCQPGKEHAMDPRPEAIIKNYKSANKLQGKVALVTGGDSGIGRAVCLCLALEGATVNFTYVKGHEDKDAEETLQALRDIKSRTGAGEPKALSGDLGYEENCRRVVEEVANAHGGRVDILVNNAAEQYVRPCITEITEQDLERVFRTNIFSYFLMTKFAVKHMGPGSSIINTTSVNAYKGNATLLDYTATKGAIVAFTRALSMQLAEKGIRVNGVAPGPIWTPLIPASFPEEKVKQFGSEVPMKRAGQPSEVAPSFVFLASEQDSSYISGQILHPNGGTIVNS

SEQ ID NO: 26241 - protein, 246 aa, Actinomadura hibisca
MTDTSFAGKNALITGGTRGIGRAVALGLARAGANVTVCYRSDAESAAAMEAELAATDGKHHVLQADIGNAGDVRRLLDEVAARMGSLDVVVHNAGLISHVPFADLEPEEWHRIVDSNLTGMYLVVRAALPLLSEGGAVVGVGSKVALVGISQRTHYTAAKAGLIGFVRSLSKELGPLGIRVNLVAPGITETDQAAHLPPVQRERYQSMTALKRLGQADEVADVVLFLAGPGARYVTGETVNVDGGM

SEQ ID NO: 26242 - protein, 316 aa, Sus scrofa domestica
MASHLVLYTGAKMPILGLGTWKSPPGKVTEAVKVAIDLGYRHIDCAHVYQNENEVGLGLQEKLQGQVVKREDLFIVSKLWCTDHEKNLVKGACQTTLRNLKLDYLDLYLIHWPTGFKPGKDPFPLDGDGNVVPDESDFVETWEAMEELVDEGLVKAIGVSNFNHLQVEKILNKPGLKYKPAVNQIEVHPYLTQEKLIEYCKSKGIVVTAYSPLGSPDRPWAKPEDPSLLEDPRIKAIAAKYNKTTAQVLIRFPMQRNLIVIPKSVTPERIAENFQVFDFELSPEDMNTLLSYNRNWRVCALMSCASHKDYPFHEEY

SEQ ID NO: 26243 - protein, 294 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQASSFIFLFFSR

SEQ ID NO: 26244 - protein, 313 aa, Medicago sativa
MATAIKFFQLNTGAKIPSVGLGTWQAEPGVVAKAVTTAVQVGYRHIDCAEAYKNQSEIGSALKKLCEDGVVKREELWITSKLWCSDHHPEDVPKALDKTLNDLQLDYLDLYLIHWPVSMKRGTGEFMGENLDHADIPSTWKALGALYDSGKAKAIGVSNFSTKKLQDLLDVARVPPAVNQVELHPGWQQAKLHAFCESKGIHLSGYSPLGSPGVLKSDILKNPVVKEIAEKLGKTPGQVALRWGLQAGHSVLPKSTNEARIKKNLDVYDWSIPEDLFPKFSEIKQDKLIKGTFFVNDTYGAFRTIEELWDGEV

SEQ ID NO: 26245 - protein, 290 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQVRS

SEQ ID NO: 26246 - protein, 484 aa, Pseudomonas sp.
MTILNFIDGSYREGSEGKSFSNVNPATGAEIGVVHEASQAEVEDAVEAAKAALTGPWGKMTTARTGQADHRVATEIERRADDFLAAEVADTVKPRHVVSHIDIPRGAANFRMFADVVSTMPGESFNTPTPDGGQAFIYTVSKPKGVDAAVCPRNFPLLLMIWKVGPELACGNTAVVKPSEEIARTAALLGDVIDAGVNHHGVFNVAQRFGPASAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLAYYPRAVEDGPTVFTGGGVPEISGAETGGFFVEPTLWIDVAHGDTVMREEIFGPCCDILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 26247 - protein, 485 aa, Achromobacter xylosoxidans
MKEIKHFINGAFVGSASGKLFDNVSPANGQVIGRVHEAGRAEVDAAVKAARAALKGPWGKMTVAERAEILHRVADGITARFDEFLEAECLDTGKPKSLASHIDIPRGAANFKVFADLLKNVANETFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVK

SEQ ID NO: 26248 - protein, 494 aa, Sorghum bicolor
MAAADVPRPSFIGGDWREPCLPVCQPSTEATIGDIPAGTAEDVEMPVARGRVSDGGALVACLWGRASQLSHTIAAKIKDRKSESLALLETLDSGKPLDEASADMDDVAACFEYYADLAEALDGKQRSPISLPMENFKSYVLKEPLGVVGLITPWNYPLLMATWKVAPALAAGCTAVLKPSELASVSCLELGAICMEIGLPPGVFNVITGLGLKLVLHYPHIPCGIRLLLLGSTETGKRIMTSAAQMVKPVSLELGGKSPLIVFDDIRDIDKAVEWTMFGILPNAGQVCSAASRLLLHEKMAKKFLDRLVHGAKNIKVSDPLEEGGRLGSVVSEGQYEKIKKFISTARSEGATILYGGARPQHLKRGFFLEPTIITDVSTSMQIWREEVFGPVICVKEFRRESEAVELANDTQYGLAGAVISSDQERCRAISKALQSAIDNCSQPCFVQAPWGGNKRMFGRELGEWGLDNYMTVKQVTKYCSDEPWGWYQPPSKL

SEQ ID NO: 26249 - protein, 380 aa, Oryza sativa
MAAATVEVTWDVEYVLWAPDCQQRVMIGINGRFPGPNITARAGDVISVTMNNKMHTEGVVIHWHGIRQFGTPWADGTASISQCAVNPGETFVYKFVADKPGTYFYHGHFGMQRAAGLYGSLIVLDSPEQPEPFRHQYDDGGELPMMLLSDWWHQNVYAQAAGLDGKDRHFEWIGEPQTILINGRGQFECTLGPARKSFEKLLNQERGDPASTIRRCAATRRSAEEERVGPYCPRSQCAPVVFNVEQGKTYRLRIASTTSLSLLNVKIQGNKMTVVEADGNHVEPFVVDDIDIYSGESYSVFFKADQKPASYWISVGVRGRHPKTVPALAILSYGNGNAAPPPLQLPAGEPPVTPAWNDTQRSKAFTYSIRARKDTNRPPP

SEQ ID NO: 26250 - protein, 554 aa, Arabidopsis thaliana
MVWFLFLVSFFSVFPAPSESMVRHYKFNVVMKNVTRLCSSKPTVTVNGRYPGPTIYAREDDTLLIKVVNHVKYNVSIHWHGVRQVRTGWADGPAYITQCPIQPGQVYTYNYTLTGQRGTLWWHAHILWLRATVYGALVILPKRGVPYPFPKPDNEKVIVLGEWWKSDTENIINEALKSGLAPNVSDSHMINGHPGPVRNCPSQGYKLSVENGKTYLLRLVNAALNEELFFKVAGHIFTVVEVDAVYVKPFKTDTVLIAPGQTTNVLLTASKSAGKYLVTASPFMDAPIAVDNVTATATVHYSGTLSSSPTILTLPPPQNATSIANNFTNSLRSLNSKKYPALVPTTIDHHLFFTVGLGLNACPTCKAGNGSRVVASINNVTFIMPKTALLPAHYFNTSGVFTTDFPKNPPHVFNYSGGSVTNMATETGTRLYKLPYNATVQLVLQDTGVIAPENHPVHLHGFNFFEVGRGLGNFNSTKDPKNFNLVDPVERNTIGVPSGGWVVIRFRADNPGVWFMHCHLEVHTTWGLKMAFLVENGKGPNQSILPPPKDLPKC

SEQ ID NO: 26251 - protein, 512 aa, Trametes villosa
MSFSSLRRALVFLGACSSALASIGPVTELDIVNKVIAPDGVARDTVLAGGTFPGPLITGKKGDNFRINVVDKLVNQTMLTSTTIHWHGMFQHTTNWADGPAFVTQCPITTGDDFLYNFRVPDQTGTYWYHSHLALQYCDGLRGPLVIYDPHDPQAYLYDVDDESTVITLADWYHTPAPLLPPAATLINGLGRWPGNPTADLAVIEVQHGKRYRFRLVSTSCDPNYNFTIDGHTMTIIEADGQNTQPHQVDGLQIFAAQRYSFVLNANQAVNNYWIRANPNRANTTGFANGINSAILRYKGAPIKEPTTNQTTIRNFLWETDLHPLTDPRAPGLPFKGGVDHALNLNLTFNGSEFFINDAPFVPPTVPVLLQILNGTLDANDLLPPGSVYNLPPDSTIELSIPGGVTGGPHPFHLHGHAFSVVRSAGSTEYNYANPVKRDTVSIGLAGDNVTVRFVTDNPGPWFLHCHIDFHLQAGLAIVFAEDAQDTKLVNPVPEDWNKLCPTFDKAMNITV

SEQ ID NO: 26252 - protein, 551 aa, Oryza sativa
RVRPRVRNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 26253 - protein, 504 aa, Lycopersicon esculentum
EDPYRYFDWNVTYGTIYPLGVPQQGILINGQFPGPDINSVTNDNLVINIHNSLDEPFLLSWNGIQNRRNSFVDGVYGTTCPIPPGRNNTFNLQVKDQIGSFYYFPSLAFHKAAGGFGGIRILSRPRIPVPFPDPANDYTILIGDWYKKNHTDLKAILDGGRKLPFPDGILINGRGPNGVTFTVDQGKTYRLRISNVGLQNSLNFRVEGHKMTLVEVEGTHTLQTTYSSLDVHAGQSYSVLITANQEAKDHYIVVSSRFTTPVLTTTAVLHYSSSNTPVSGPPPGGPTIQIDWSLNQARSIRTNLSASGPRPNPQGSYHYGMINTTKTIRLASSAGQVNGKQRYAVNSVSFVPLDTPLKLLDYFKIGGFRVGSIPDSPTGGGIYQDTSVLGVNYRQFIEIIFENNEDIVQSWHLDGYSFWVVGMDGGQWTQASRNGYNLRDAVSRCTTQVYPKSWTAIYIALDNVGMWNLRTEFWARQYLGQQLYMRVYTDSTSTSLRDEYPIPR

SEQ ID NO: 26254 - protein, 561 aa, Arabidopsis thaliana
MAATCSLLASFLLCFALLSAVSFAADPFVSYDFRVSYLTASPLGVPQQVIAVNGQFPGPLLNATTNYNVVVNVFNHLDEPLLLTWPGIQMRRNSWQDGVLGTNCPIPPRWNFTYQFQVKDQIGSFFYSPSLNFQRASGGFGPIVINNRDIIPIPFPQPDGELIFIIGDWYTQDHKALRRALDSGKELGMPDGVLINGKGPYKYNSSVPDGIDYLTFHVEPGKTYRIRVHNVGISTSLNFRIQNHSLLLVETEGHYTSQANFTDFDVHVGQSYSFLVTMDQDATSDYYIVASARFVNETVWQRVTGVAILHYSNSKGPVSGPLPVPKTDVSSPWSAMSQPKTIRQNTSASGARPNPQGSFHYGQINITNTYILRSLPPTIINGALRATLNGISFVNPSTPVRLADRNKVKGAYKLDFPDRPFNRPLRLDRSMINATYKGFIQVVFQNNDTKIQSFHVDGYSFFVVGMDFGIWSEDKKGSYNNWDAISRSTIEVYPGGWTAVLISLDNVGVWNIRVENLDRWYLGEETYMRITNPEEDGKTEMDPPDNVLYCGALKNLQKYSS

SEQ ID NO: 26255 - protein, 339 aa, Hordeum vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIQADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 26256 - protein, 371 aa, Ipomoea purpurea
MLSTITATVPSRVERLAGSGIQRIPKEYIRPEEERRSIRDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKNASDYIDATREYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFARHIKHNLFRQSDQEAAHTPKPDNDDDHQSN

SEQ ID NO: 26257 - protein, 382 aa, Phaseolus vulgaris
MAIDCMTNIQTMSQPQKHHHQDNKEDEAPLVFDASLLRHQLNLPKQFIWPDDEKPCMNVPELVVPLIDLRGFLSGDPVATMEAARMVGEACQKHGFFLVVNHGIDANLISHAHSYMDDFFEVPLTQKQRAQRKTGEHCGYASSFTGRFSSKLPWKETLSFQFSAEEKSSTIVKDYLCNTLGQEFEQFGRVYQDYCDAMSNLSLGIMELLGMSLGVGKACFREFFEENDSIMRLNYYPPCQKPDLTLGTGPHCDPTSLTILHQDQVGGLQVFVDNEWHSINPNFNAFVVNIGDTFMALSNGRYKSCLHRAVVNSKTTRKSLAFFLCPKGDKVVSPPSELVDDLTPRLYPDFTWPMLLEFTQKHYRADMKTLEAFTNWLQQKRS

SEQ ID NO: 26258 - protein, 385 aa, Phaseolus vulgaris
MAIDMHPIPIMPQPSNQEIKEQDQHPLVFDASLLRHQLHIPSQFVWPDEEKACLNEPELPVPFIDLGGFLSGDPLAATEASRLVGEACQKHGFFLVVNHGIQQQLISDAHLYMDHFFALPLSHKQRAQRMPGEHCGYASSFTGRFSSKLPWKETLSFQYSPRNDSQTLVKDYLCDKMGKEFEKFGNVYQDYCEAMSNLSLGIMELLGLSLGVGRGYFREFFEENNSIMRLNYYPPCQKPDLTLGTGPHCDPTSLTILHQDQVGGLQVCVDNEWHSIKPDVNAFVVNVGDTFMALSNGRYKSCLHRAVVNSETTRKSLAFFLCPRSDKVVSPPCELVDKLSPRLYPDFTWPMLLEFTQKHYRADMKTLEAFTNWLQRRSNFDNHIM

SEQ ID NO: 26259 - protein, 379 aa, Nicotiana tabacum
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLVPKKDKVVSPPNELVDTNNPRIYPDFTWPTLLEFTQKHYRADMNTLQTFSNWLKQKTAQV

SEQ ID NO: 26260 - protein, 355 aa, Dianthus caryophyllus
NSTKIAPSRVETLASSGIECIPKEYVRPEEELTSIGDVFEEEKKDDGPQVPTIDLKDIASEDPEVRAKAIHELKKAAMEWGVMHIVNHGISEELINRVKVAGETFFEFPIEEKEKYANDQDSGNVQGYGSKLANNASGQLEWEDYFFHLAYPEEKRDMSIWPKSPEDYIPAVSEYSKELRSLATRIFSALSVALGLEEGRLEKEVGGLEELHLQMKINYYPKCPQPELALGVAAHTDVSALTFILHNMVPGLQLFYEGKWVTAKCVPNSIIMHIGDTIEILSNGKYKSILHRGLVNKEKVRISWAVFCEPPKEKIILKPLLDLVNESDPAQYPPRTFAQHIQHKSSERLRMSNPQ

SEQ ID NO: 26261 - protein, 298 aa, Picea glauca
MAMLSGGLQKEEEMAKIDKACEEWGFFQVVNHGVPHSLMDDITRMGKEFFRLPAEEKEKYAIRDFQGYGQIFVVSEEQKRDWGDLLGLIISPPQSRNLSVWPSVPSEFRQIVEAYNMEIRSLAVKILSLIAENLHLKPDYFEQSFGNTYQKMRMNYYPACPRPDLVLGLSPHADGSGITLLLQDEKVEGLHVRKDDIWVAVQPIPYALVINIGNLLEVITNGRYKSIQHRAVTNKHKSRLSIDVFYSPGFDAEIGPAPELIDESHPCLFRKFIHEDHIKYYMSRKVDGKTSFYEYAGV

SEQ ID NO: 26262 - protein, 370 aa, Phaseolus vulgaris
MLIPHPSMLLASQNTNMEPQQINLQAPTPNQSNIPSEFVWPDNEKPCLEPPKLKIPPIDMKGFLSGDPETVSAICAEVNAACRKHGFFLVVNHGVDKKLVEKAHKLIDTFFCMELPEKQKLQRKLGEHCGYANSFIGRFSSKLPWKETLSFHYAPDTKTVEDYFLNSMGEEFREFGSFFQEYCEVMSNLSLEIMELLGMSLGVSRECFRDFFKNNESVMRLNYYPPCHKPELALGTGPHCDPTSLTVLHQDQVEGLQVFVDGKWCSVAPKEDAFVVNIGDTFMALSNGIFKSCLHRAVVNNQIVRKSLAFFLCPNKDKVVSAPKELITVENPKKYPDFTWPNLLEFTQLHYRSDPETLDAFANWVLEKNK

SEQ ID NO: 26263 - protein, 379 aa, Nicotiana tabacum
MAIDCMITNVKSPILRILEDEKKPLIFDASQMKREYNIPTQFVWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSISPNFNAFVVNIGDTFMALSNGRYKSCLHRAVVNNKTPRKSLAFFLCPKKDKVVSPPTELVDTNNPRIYPDFTWPTLLEFTQKHYRADMNTLQTFSNWLQQKTAQV

SEQ ID NO: 26264 - protein, 367 aa, Nicotiana tabacum
MHDETQNEKTTSLVFDALFLQNNSNIPQQFIWPEGERPCPEPPPPLHVPPIDLNDYLSGDPLAVSNATRLVNQACRKHGFFLVVNHGIDSKLINEAHKNMDFFFEKPLVEKERAKRKLGDYCGYASSFTSRFSCNLPWKETLSFRYSAEVPSSQHIVQSYILNVMGQDYTHFGNVYQKYCEEMSKLSLKVMELLGESLGVGRAYFREFFEGNDSIMRLNYYPPCKKPDLTLGTGPTCDPTSLTILHQDNVGGLEVFVDEKWYSIPPNTNAFVVNIGDTFMVMSNGTYKSCLHRAVVNSRKPRKSLAFFLCPKKDKIVSPPKELITRNVPRKFPDFTWPVFLEFTQKHYRADKKTLDAFVHWLLHKGY

SEQ ID NO: 26265 - protein, 299 aa, Arabidopsis thaliana
MACINGENRDFSSSSSLSSLPMIVSRNFSARDDGETGDEFPFERIFPVYARGTLNPVADPVLLDFTNSSYDPIWDSIREEAKLEAEEEPVLSSFLYASILSHDCLEQALSFVLANRLQNPTLLATQLMDIFCNVMVHDRGIQSSIRLDVQAFKDRDPACLSYSSAILHLKGYLALQAYRVAHKLWKQGRKLLALALQSRVSEVRTAVIGDRVSILHGVTLGGTGKETGDRHPNIGDGALLGACVTILGNIKIGAGAMVAAGSLVLKDVPSHSMVAGNPAKLIGFVDEQDPSMTMEHGES

SEQ ID NO: 26266 - protein, 308 aa, Arabidopsis thaliana
MNGDELPFESGFEVYAKGTHKSEFDSNLLDPRSDPIWDAIREEAKLEAEKEPILSSFLYAGILAHDCLEQALGFVLANRLQNPTLLATQLLDIFYGVMMHDKGIQSSIRHDLQAFKDRDPACLSYSSAILHLKVILYSKVFPLAFQGYHALQAYRVAHKLWNEGRKLLALALQSRISEVVAARIGEGILLDHGTGVVIGETAVIGNGVSILHFSLSQGVTLGGTGKETGDRHPKIGEGALLGACVTILGNISIGAGAMVAAGSLVLKDVPSHSVVAGNPAKLIRVMEEQDPSLAMKHVTVLERICRCY

SEQ ID NO: 26267 - protein, 347 aa, Spinacia oleracea
MLAVSYAIPSCCINRFYIREFSSSLQPALHHPWYKKRFGCCSTNQENCSLGSPTHLPRMPGGDLSVAPSVGHLTANNEAWLWDQIKGEARRDADSEPALASYLYSTILSHSSLERSLSFHLGNKLCSSTLLSTLLYDLFLNILSSDSSLLDAVVADLRAARVRDPACVSFSHCLLNYKGFLACQSHRVAHKLWNQDRRPLALALHSRISDVFAVDIHPAARIGKGILFDHATGVVIGETAIIGDNCSILHHVTLGGTGKAGGDRHPKVGDGVLIGAGATILGNVRIGDGAKIGAGSVVLIDVPPRTTAVGNPARLIGGKEKPSQNSDVPGESMDHTSFISEWSDYII

SEQ ID NO: 26268 - protein, 808 aa, Arabidopsis thaliana
MANPKLTRVLSTRDRVQDTLSAHRNELVALLSRYVDQGKGILQPHNLIDELESVIGDDETKKSLSDGPFGEILKSAMEAIVVPPFVALAVRPRPGVWEYVRVNVFELSVEQLTVSEYLRFKEELVDGPNSDPFCLELDFEPFNANVPRPSRSSSIGNGVQFLNRHLSSVMFRNKDCLEPLLDFLRVHKYKGHPLMLNDRIQSISRLQIQLSKAEDHISKLSQETPFSEFEYALQGMGFEKGWGDTAGRVLEMMHLLSDILQAPDPSSLEKFLGMVPMVFNVVILSPHGYFGQANVLGLPDTGGQVVYILDQVRALETEMLLRIKRQGLIPDAKGTTCNQRLERVSGTEHTHILRVPFRSEKGILRKWISRFDVWPYLENYAQDAASEIVGELQGVPDFIIGNYSDGNLVASLMAHRMGVTQCTIAHALEKTKYPDSDIYWKDFDNKYHFSCQFTADLIAMNNADFIITSTYQEIAGTKNTVGQYESHGAFTLPGLYRVVHGIDVFDPKFNIVSPGADMTIYFPYSEETRRLTALHGSIEEMLYSPDQTDEHVGTLSDRSKPILFSMARLDKVKNISGLVEMYSKNTKLRELVNLVVIAGNIDVNKSKDREEIVEIEKMHNLMKNYKLDGQFRWITAQTNRARNGELYRYIADTRGAFAQPAFYEAFGLTVVEAMTCGLPTFATCHGGPAEIIEHGLSGFHIDPYHPEQAGNIMADFFERCKEDPNHWKKVSDAGLQRIYERYTWKIYSERLMTLAGVYGFWKYVSKLERRETRRYLEMFYILKFRDLVTIHKHFLLLPYKISRISFNL

SEQ ID NO: 26269 - protein, 822 aa, Beta vulgaris
MAPKLTRIPSMRERVEDTLSVHRNELVSLLSKYVAQGKCLLQPHHLIDGLESVIGEDKGKQILSDGPFSEVLRSAQEAIVVPPFVAIAVRPRPGVWEYVRVNVSELNVEQLTVSEYLHFKEELVDGKADDHYVLELDFEPFNESVPRPTRSSSIGNGVQFLNRHLSSSMFCNKDCLEPLLDFLRVHKHKGVVMMLNDRIQTIQRLQSALSKAEDYLIKLPADTPYSEFEFVIQGMGFERGWGDTAERVLEMMHLLLDILQAPDPSTLETFLGRLPMVFNVVILSVHGYFGQAHVLGLPDTGGQIVYILDQVRSLEHEMLQRIKKQGLDVTPRILIVSRLIPDAKGTTCNQRMEKVSGTEHASILRVPFRSEKGILRKWISRFDVWPYLETFTEDAAGEIIGELQGRPDLIIGNYSDGNIVASLLSHKMGVTQCNIAHALEKTKYPDSDIYWKRFEDKYHFSCQFSADLMAMNHADFIITSTYQEIAGTKNTVGQYESHKAFTFPGLYRVVHGIDVFDPKFNIVSPGADMAIYFPFSEKDVTCLTSLHRLIEQLLFKPEQNEEHIGVLDDTSKPIIFSMARLDRVKNITGLVECYGKNAKLRELANLVVVAGYNDVKKSNDREEIAEIEKMHRLIQEYNLRGQFRWIASQTNRVRNGELYRYICDKGGIFAQPAFYEAFGLTVVEAMTCGLPTFATCHGGPAEIIEDGVSGFHIDPYHADQAEKMTEFFVKCREDPNYWTKISAGGLLRIKERYTWQKYSERLMTLAGVYGFWKYVSKLERRETRRYLEMFYILKFRDLANSVPLATDEEPSTTDAVATFRGP

SEQ ID NO: 26270 - protein, 816 aa, Oryza sativa
MGEAAGDRVLSRLHSVRERIGDSLSAHPNELVAVFTRLVNLGKGMLQAHQIIAEYNNAISEADREKLKDGAFEDVLRSAQEGIVISPWVALAIRPRPGVWEYVRVNVSELAVELLTVPEYLQFKEQLVEEGTNNNFVLELDFEPFNASFPRPSLSKSIGNGVQFLNRHLSSKLFHDKESMYPLLNFLRAHNYKGMTMMLNDRIRSLSALQGALRKAEEHLSGLSADTPYSEFHHRFQELGLEKGWGDCAKRSQETIHLLLDLLEAPDPSTLEKFLGTIPMVFNVVIMSPHGYFAQANVLGYPDTGGQVVYILDQVRAMENEMLLRIKQQGLNITPRILIVTRLLPDATGTTCGQRLEKVLGTEHTHILRVPFRTENGIVRKWISRFEVWPYLETFTDDVAHEIAGELQANPDLIIGNYSDGNLVACLLAHKMGVTHCTIAHALEKTKSPNSDLYWKKFEDHYHFSCQFTTDLIAMNHADFIITSTFQEIAGNKDTVGQYESHMAFTMPGLYRVVHGIDVFDPKFNIVSPGADMSIYFPYSESRKRLTSLHPEIEELLYSEVDNNEHKFMLKDRNKPIIFSMARLDRVKNLTGLVELYGRNPRLQELVNLVVVCGDHGNPSKDKEEQAEFKKMFDLIEQYNLNGHIRWISAQMNRVRNGELYRYICDTKGAFVQPAFYEAFGLTVVESMTCGLPTFATAYGGPAEIIVNGVSGFHIDPYQGDKASALLVEFFEKCQEDPSHWTKISQGGLQRIEEKYTWKLYSERLMTLTGVYGFWKYVSNLERRETRRYLEMLYALKYRTMASTVPLAVEGEPSNK

SEQ ID NO: 26271 - protein, 341 aa, Citrus unshiu
QVKYVVELARALANTEGVYRVDLLTRQIASPEVDSSYGEPNEMLSCPSDGTGSCGAYIIRIPCGARDKYIAKESLWPYIHEFVDGALNHIVNMARAIGEQVNGGKPTWPYVIHGHYADAGEVAGHLPGGLNVPMVLTGHSLGRNKFEQLLKQGRLPKDINASYKIMRRFEAEELGLDASEMVVTSTRQEIEMQWGLYDGFDLKLERKLRVRRQRGVSCFGRFMPRMVVIPPGMDFSYVTTQDTMGGDTDLKSLIVNDRTQTTRNLPPMWSEVMRFFTNPHKPTILALSRPDPKKNVTTLLKAFGECQPLRELANMTLILGNRDDIEDMSNSSSVVLTTVLN

SEQ ID NO: 26272 - protein, 348 aa, Citrus unshiu
QIKYVVELARALARMPGVYRVDLFSRQVSSPEVDWSYGEPAEMLTGGPEDDGIEVGESSGAYIIRIPFGPRDKYLRKELLWPYIQEFVDGALAHCLNMSKVLGEQIGGGQPVWPYVIHGHYADAGDSAALLSGALNVPMVLTGHSLGRNKLEQLLKQGRQSKEDINSTYKIMRRIEGEELSLDAAELVITSTKQEIDEQWGLYDGFDVKLEKVLRARARRGGNCHDRYMPRMVVIPPGMDFSNVVAQEDTPEVDGELTSLIGGTDGSSPKAIPAIWSDVMRFLTNPHKPMILALSRPDPKKNITTLLKAFGECRPLREFANLTLIMGNRDDIEEMSSGNASVLITVLK

SEQ ID NO: 26273 - protein, 1084 aa, Oryza sativa
  unsure (1)..(1084): unsure at all Xaa locations
MAGNEWINGYLEAILDSGGAAGGGGGGGGGGGGGGGGGGGGGGGGVDPSSPTTGTTSPRGPHMNFNPTHYFVEEVVKGVDESDLHRTWIKVVATRNARERSTRLENMCWRIWHLARKKKQLELEGILRISARRKEQEQVRRETSEDLAEDLFEGEKADTVGELAQQDTPMKKKFQRNFSELTVSWSDENKEKKLYIVLISLHGLVRGDNMELGRDSDTGGQVKYVVELARALAMMPGVYRVDLFTRQVSSPEVDWSYGEPTEMLTSGSTDGEGSGESAGAYIVRIPCGPRDKYLRKEALWPYLQEFVDGALAHILNMSKALGEQVSNGKLVLPYVIHGHYADAGDVAALLSGALNVPMVLTGHSLGRNKLEQIMKQGRMSKEEMDSTYKIMRRIEGEELALDAAELVITSTRQEIDEQWGLYDGFDVKLEKVLRARARRGVSCHGRFMPRMVVIPPGMDFSSVVVPEDTSDGDDGKDFEIASPRSLPPIWAEVSRFWTNPHKPMILALSRPDPKKNITTLVKAFGECRPLRELANLILSMGTRDDIDGMSAGNASVLTTVLKLIDKYDLYGSVAFPKYHKQSDVPEIYRLTGKMKGVFINPALVEPFGLTLIEAAAHGLPIVGTKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLRLSIDGERGSSMNDAPSSDPQDSVQRIMNKIKRSSPAETDGAKIPAEAAATATSGAMNKYPLLRRRRRLFVIAVDCYGDDGSASKRMLQVIQEVFRAVRSDSQMSRISGFALSTXMPLPETLKLLQLGKIPPTDFDALICGSGSEVYYPSTAQCVDAGGRLRPDQDYLLHINHRWSHDGAKQTIAKLAHDGSGTNVEPDVESCNPHCVSFFIKDPNKVRTMDEMRERVRMRGLRCHLMYCRNATRLQVVPLLASRSQALRYLFVRWGLSVGNMYLIVGEHGDTDHEEMLSGLHKTVIIRGVTEKGSEQLVRSSGSYQREDVVPSESPLIAFTKGDLKADEIMRALKEVTKAASGM

SEQ ID NO: 26274 - protein, 213 aa, Solanum commersonii
MAIKVHGPMMSPAVMRVVATLKEKDLDFELIPVNMQAGDHKKEPFISLNPFGQVPAFEDGDLNLFESRAITQYIAHTYADKGNQLLPNDPKKMAIMSVWIEVEAQKFDPIGSKLGFEIVIKPMLGMVTDDAVVAENEEKLGKLLDVYESRLKESKYLGGESFTLADLHHAPSLHYLMGSKVKSLFDARPHVSAWCADILARPAWSKTLELSKQ

SEQ ID NO: 26275 - protein, 348 aa, Danio rerio
MPGPVSSKARVYADANTVKSKEYWDYEAHVPSWSNQDDYQLVRKLGRGKYSEVFEAININSNDRVVVKILKPVKKKKIKREIKILENLRGGTNIIRLVDTVKDPVSRTPALVFEYINNTDFKDLYQRLTDFDIRFYLYELLKALDYSHSMGIMHRDVKPHNVMIDHQMRKLRLIDWGLAEFYHPAQEYNVRVASRSYKGPELLVDYQMYDYSLDMWSLGCMLASMIFQKEPFFHGQDNYDQLVRIAKVLGTEELFSYLNKYHIELDTRFKDLLGQQTRKRWENFVLPENQHLVSPEALDLLDKLLRYDHQQRLTAQEAMEHPYFYPVLKGQPLSNSEGALAISSSTTT

SEQ ID NO: 26276 - protein, 293 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKNTWITTPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELSRFRVMGTPNEDTWPGVTTLPDFKSAFPKWPSKDLATIVPNLDGAGLDLLDKIVRLDPSKRITARNALEHEYFKDIGYVP

SEQ ID NO: 26277 - protein, 314 aa, Dunaliella tertiolecta
MDAYEKLEKIGEGTYGKVYKARDINTGKLVALKKTRLEMEEEGVPSTTLREVSLLLMLSESNHVVKLIAVEHVEENGKPCLYLVFEYLSTDMKKWMDRNGRGPAHPLPKPAIKSLTYQLIKGLAHCHKHGVMHRDLKPQNLLVDDSIMCCKIADLGLGRAFSIPIKSYTHEIVTLWYRAPEVLLGSTHYSTPVDMWSVGCIFAELVRKTPLFPGDCELQQLLHIFKLLGTPNEEVWPGVSKLRDWHEFPQWHPQDLSRIFPTLEPEGVDLLKRMIEYDPAKRISAKEALKHPYFDDPMIREVDQQENPEVRARD

SEQ ID NO: 26278 - protein, 375 aa, Nicotiana tabacum
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLVNANCDLKICDFGLARPNIENENMTEYVVTRWYRAPELLLNSSDYTAAIDVWSVGCIFMELMNRKPLFGGKDHVHQIRLLTELLGTPTEADLGFLQNEDAKRYIRQLPQHPRQQLAEVFPHVNPLAIDLVDKMLTFDPTRRITVEEALDHPYLAKLHDAGDEPICPVPFSFDFEQQGIGEEQIKDMIYQEALSLNPEYA

SEQ ID NO: 26279 - protein, 369 aa, Cyprinus carpio
MATAAVSAPAGGGPNPGSGAEMVRGQAFDVGPRYTNLSYIGEGAYGMVCSAYKRDNKVRVAIKKISPFEHQTYCQRTLREIKILLRFKHENIIGINDIIRTTTIDQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINIKARNYLLSLPLRCKVPWNRLFPNADPKALDLLDKMLTFNPHKRIEVEEALAHPYLEQYYDPTDEPVAEAPFKFDMELDDLPKETLKELIFEETARFQPGYRP

SEQ ID NO: 26280 - protein, 392 aa, Cyprinus carpio
MAESGSSAAAAGAAGSSSSAAGAGAAVAVGGANGAAGPKPGLESVKGQNFDVGPRYTDLQYIGEGAYGMVCSAFDNVNKIRVAIKKISPFEHQTYCQRTLREIKILLRFRHENIIGINDILRARRIEYMRDVYIVQDLMETDLYKLLKTQQLSNDHVCYFLYQILRGLKYIHSANVLHRDLKPSNLLINTTCDLKICDFGLARIADPEHDHTGFLTEYVATRWYRAPEIMLNSKGYTKSIDMWSVGCILAEMLSNRPIFPGKHYLDQLNHILGILGSPTQDDLNCIINMKARNYLQALPQKPKIPWNKLFPKADNKALDLLDRMLTFNPIKRITVEEALAHPYLEQYYDPSDEPVAEEPFTFNMELDDLPKEKLKELIYEETARFQATYQGS

SEQ ID NO: 26281 - protein, 367 aa, Homo sapiens
MSSPPPGGSGFYRQEVTKTAWEVRAVYRDLQPVGSGAYGAVCSAVDGRTGAKVAIKKLYRPFQSELFAKLAYRELRLLKHMRHENVIGLLDVFTPDETLDDFTDFYLVMPFMGTDLGKLMKHEKLGEDRIQFLVYQMMKGLRYIHAAGIIHRDLKPGNLAVNEDCELKILDFGLARQADSEMTGYVVTRWYRAPEVILNWIAYTQTVDIWSVGCIMAEMITGKTLFKGSDHLDQLKEIMKVTGTPPAEFVQRLQSDEAKNYMKGLPELEKKDFASILTNASPLAVNLLEKMLVLDADIRLTAGEFLSHPYFESLHDTEDEPQVQKYDDSFDYFDRTLDEWKRVTYKEVLSFKPPRQLGARVSKETPL

SEQ ID NO: 26282 - protein, 365 aa, Homo sapiens [sequence omitted]

SEQ ID NO: 26283 - protein, 428 aa, Pisum sativum
MRDQKGEVQYFIGVQLDGSQHVEPLHNRIAEDTAKEGENLVKKTAENVDDALRELPDANMKPEDLWMNHSKMVHPKPHRREDAAWRAIQKIMESGEQIGLKHFKPIKPLGSGDTGSVHLVELCGTDHQFAMKAMDKGVILNRNKEHRACTEREILDMLDHPFLPALYASFQTKTHICLITDYCPGGELFMLLDRQPAKVLKEDAVRFYATEVVVALEYLHCQGIIYRDLKPENVLLQSTGHVSLTDFDLSCLTSCKPQLLVPSTNDKKKGQHGPIFMAEPMRASNSFVGTEEYIAPEIITGSGHTSAVDWWALGILLYEMFYGYTPFRGKNRQRTFANILHKDLKFPKSKQVSLGAKQLIYYLLQRDPTSRLGSKGGANDIKNHSFFKGINWALVRCTKPPELDAPLFDTNKEEKEKEDKYVDNGQRI

SEQ ID NO: 26284 - protein, 371 aa, Petroselinum crispum
MANPGDGQYTDFPAIQTHGGQFIQYNIFGNLFQVTKKYRPPIMPIGRGAYGIVCSIMNTETNEMVAVKKIANAFDNYMDAKRTLREIKLLRHLDHENVIAITDVIPPPLRREFTDVYIATELMDTDLHQIIRSNQGLSEEHCQYFLYQLLRGLKYIHSANIIHRDLKPSNLLLNANCDLKICDFGLARHNTDDEFMTEYVVTRWYRAPELLLNSSDYTVAIDVWSVGCIYMELMNRKPLFAGKDHVHQMRLLTELLGSPTEADLGFVRNEDAKRFILQLPRHPRQPLRQLYPQVHPLAIDLIDKMLTFDPSKRITVEEALAHPYLARLHDIADEPICTKPFSFEFETAHLGEEQIKDMIYQEALAFNPDCA

SEQ ID NO: 26285 - protein, 293 aa, Homo sapiens [sequence omitted]

SEQ ID NO: 26286 - protein, 316 aa, Medicago sativa
MEKPGETIAVVLSAKEAFEKLEKVGEGTYGKVYRAREKATGKIVALKKTRLHEDDEGVPPTTLREVSILRMLSRDPHVVRLLDVKQGQNKEGKTVLYLVFEYMDTDLKKFIRSFRQTGQNIPPPTIKGLMYQLCKGVAFCHGHGILHRDLKPHNLLMDRKTMMLKIADLGLARAFTVPLKKYTHEILTLWYRAPEVLLGATHYSMAVDMWSVACIFAELVTKTALFPGDSELQQLLHIFRLLGTPNEDVWPGVSKLMNWHEYPQWGPQSLSKAVPGLEEAGVDLLSQMLQYEPSKRLSAKKAMEHPYFDDLDKTHL

SEQ ID NO: 26287 - protein, 371 aa, Medicago sativa
MARVNQNGVAEFPAVQTHGGQFVQYNVFGNLFEVTAKYRPPIMPIGRGAYGIVCSLLNTETNELVAVKKIANAFDNHMDAKRTLREIKLLRHLDHENVIGLRDVIPPPLRREFNDVYITTELMDTDLHQIIRSNQNLSDEHCQYFLYQILRGLRYIHSANIIHRDLKPSNLLLNANCDLKIIDFGLARPTMESDFMTEYVVTRWYRAPELLLNSSDYTSAIDVWSVGCIFMELMNKKPLFPGKDHVHQMRLLTELLGTPTDADVGLVKNDDARRYIRQLPQYPRQPLNRVFPHVHPLAIDLVDKMLTIDPTRRITVEEALAHPYLEKLHDVADEPICMEPFSFEFEQQHLDEEQIKEMIYREALALNPEYA

SEQ ID NO: 26288 - protein, 355 aa, Craterostigma plantagineum
MEKYELVKDIGSGNFGVARLMRNKETKELVAMKYIERGHKIDENVAREIINHRSLRHPNIIRFKEVVLTPTHLAIVMEYAAGGELFERICNAGRFSEDEARYFFQQLICGVHYCHALQICHRDLKLENTLLDGSPAPRLKSCDFGYSKSSLLHSRPKSTVGTPAYIAPEVLSRREYDGKLADVWSCGVTLYVMLVGAYPFEDQEDPFFFRKTILWIMAVQYKIPDYVRISQSCRHLLSRIFVANPLRRITIKEIKSHLWFLKNLPRELTEVAQAAYFRRDNPTYSLQSEEEIMKIVEEAKVPPQASRSIGGFGWGTEEDEENVEEEEEGESEGEEDEYEKQVKAAHASGEVPPLT

SEQ ID NO: 26289 - protein, 311 aa, Lycopersicon esculentum
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDVLWKLEYALRLQESVI

SEQ ID NO: 26290 - protein, 602 aa, Kluyveromyces lactis
MSHDPNQQQPHGGSGQGHHQRQLTNHAQGQHIGKYQIIKTLGEGSFGKVKLAYHISTGQKVALKIINKKVLAKSDMQGRIEREISYLRLLRHPHIIKLYDVIKSKDEIIMVIEYAGNELFDYIVQRDKMPEQEARRFFQQIISAVDYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYTIPNFLSQGAASLIKKMLIVNPVNRITVHEIMQDEWFKVDLPDYLVPAESTHQENSESKTEDGGPSVPLELIDDSLVQTLSNTMGYDVDEIYEALESDEDHPSLNEIRDAYQLIKENRNLINDIKVNKQQSNDLDTFLSQSPPTFEQSLHAPPGSKNRHSHRHSKRTQQRTYQYHYGNGSQDGDSTIAILPSSLPQIHRANMVAQGSQAAAKISPLSVKKSKTRWHFGIRSRSYPLDVMGEIYIALKNLGAEWAKPSEEDLWTIRVRWRYNIDMPDDEMKNKQIPDLMKMVIQLFQIETNNYLVDFKFDGWESSNGVVYSSRNDDEMSTFSAYPFLHLATRLIMELAVNSQGS

SEQ ID NO: 26291 - protein, 504 aa, Solanum tuberosum
MSSRGGGIAESPYLRNYRVGKTLGHGSFGKVKIAEHLLTGHKVAIKILNRRKMKTPDMEEKLRREIKICRLFVHPHVIRLYEVIETPTDIYVVMEYVKSGELFDYIVEKGRLQEDEARKIFQQIIAGVEYCHKNMVVHRDLKPENLLLDARRNVKIADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVPDIRQHQWFKIHLPRYLAVPPPDARQHLKKLDEEILQQVSRMGLDRDQLLDSLQKRIQDDATVAYYLLYDNRSMASSGYLGAEFQESVDCYSPGLFPNLDLQLSTGNGVSEESLRRPFRKEKMWLVGLQSPANPKEIMNQVLGTLLELNVRWKKIGHYNMKCLWCHDLHLHSMANNHMNDDDHFISNATAISTHLQPQPTVKFEMQLYKTEDEKYLLDLQRISGPQFLFLDFCAGFIRQLEGPQ

SEQ ID NO: 26292 - protein, 512 aa, Solanum tuberosum
MDGTAVQGTSSVDSFLRNYKLGKTLGIGSFGKVKIAEHTLIGHKVAVKILNRRKIRNMDMEEKVSREIKILRLFMHGHISRLYEVIETPSDIYVVMEYVKSGELFDYIVEKGRLQEDEARNFFQQIISGVEYCHINMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGYITLPSHLSAGARDLIPRMLIVDPMKRMTIPEIRLHPWFQAHLPRYLAVPPPDTMQQAKKIDEEILQEVVKMGFDRNNLTESLRNRVQNEGTVPYYLLLDNRHRVSTGYLGAEFQESMEYGYNRINSNEPLLPCWQRFPGIMDYQQAGARQFPIERKWALGLQSRAHPREIMTEVLKALQELNVCWKKIGQYNMKCRWVPSVPGHHEGMGVNSMHGNQFFGDDSSIIENDGDTKLTNVVKFEVQLYQTREEKYLLDLQDQGSQFLFLDLCAAFLAQLRVL

SEQ ID NO: 26293 - protein, 514 aa, Ipomoea batatas
MGNRTSRHKHGEKHRSEAGSHQTHIEYTKSPGQGAGLPVRPPSIPKSVSKSDAILGKAYEDVRAHYSLGKELGRGQFGVTYLCTEIRTGKQYACKSISKKKLVTKGDKDDMRREVQIMQHLSGQPNIVEFKGAYEDANSVYLVMELCAGGELFDRIIAKGHYSERAAASLCRSIVNVVHTCHFMGVMHRDLKPENFLLSDKTENAALKATDFGLSVFIEEGRVYKDLVGSAYYVAPEVLGRKYGKEADVWSAGVMLYILLSGVPPFWAETERGIFNAILKGELDFQTKPWPSISSIAKDLVRGMLAPDPKRRLTAAQVLEHPWMREDGEASDRPLDSAVLSRMKQFRAMNKLKKLALKFIAENLSEEEIHGLKAMFTNIDTDNSGTITYEELKKGLAQLGANLTEAEVKQLMEAADVDGNGSIDYIEFITATMHKHRLEREENLYKAFQYFDKDSSGFITRDELETAMKEHGIADAATIKEIISEVDADHDGRINYEEFCTMMRSGTKQQAKLF

SEQ ID NO: 26294 - protein, 348 aa, Caenorhabditis elegans
MPLFKRRDGSGPAPNATIREKYDFRDVLGTGAFSKVFLAESKSDAGQMYAVKCIDKKALKGKEESLENEIKVLRKLRHNNIVQLFDTYDEKQFVYLVMELVTGGELFDRIVAKGSYTEQDASNLIRQVLEAVGFMHDNGVVHRDLKPENLLYYNQDEDSKIMISDFGLSKTEDSGVMATACGTPGYVAPEVLQQKPYGKAVDVWSIGVIAYILLCGYPPFYDESDANLFAQIIKGEYEFDAPYWDQISGSAKDFITHLMCCDPEARFTCQDALSHPWISGNTAYTHDIHGTVAVHLKKSLAKRNWKKAYNAAAAIRQLQMLRLSSNSNRLQKQASQQQPEPPTPAFHA

SEQ ID NO: 26295 - protein, 589 aa, Rattus norvegicus
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSSAITSPKGSLPPAALESSDSTNTTIEDEDAKAPRISDILNSVRRGCGTPEAEGPLSVGPPPCLSPGLLGPLPTPSPRISDILNSVRRGSGTPEAEGLPPVGPPPCPSPTLPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRPDGKWQNVHFHCSGAPVAPLQ

SEQ ID NO: 26296 - protein, 790 aa, Arabidopsis thaliana
MPCTTYLPLLLLLFLLPPPSVQSKVIIKGNQTILSFKAIFRLGFFSTTNGSSNWYLGISYASMPTPTHVWVANRIRPVSDPDSSTLELTSTGYLIVSNLRDGVVWQTDNKQPGTDFRFSETGNLILINDDGSPVWQSFDNPTDTWLPGMNVTGLTAMTSWRSLFDPSPGFYSLRLSPSFNEFQLVYKGTTPYWSTGNWTGEAFVGVPEMTIPYIYRFHFVNPYTPTASFWYIVPPLDSVSEPRLTRFMVGANGQLKQYTWDPQTQSWNMFWLQPEDPCRVYNLCGQLGFCSSELLKPCACIRGFRPRNDAAWRSDDYSDGCRRENGDSGEKSDTFEAVGDLRYDGDVKMSRLQVSKSSCAKTCLGNSSCVGFYHKEKSNLCKILLESPNNLKNSSSWTGVSEDVLYIREPKKGNSKGNISKSIIILCSVVGSISVLGFTLLVPLILLKRSRKRKKTRKQDEDGFAVLNLKVFSFKELQSATNGFSDKVGHGGFGAVFKGTLPGSSTFVAVKRLERPGSGESEFRAEVCTIGNIQHVNLVRLRGFCSENLHRLLVYDYMPQGSLSSYLSRTSPKLLSWETRFRIALGTAKGIAYLHEGCRDCIIHCDIKPENILLDSDYNAKVSDFGLAKLLGRDFSRVLATMRGTWGYVAPEWISGLPITTKADVYSFGMTLLELIGAREIIQGNVDSVVDSRLNGEYNTEEVTRMATVAIWCIQDNEEIRPAMGTVVKMLEGVVEVTVPPPPKLIQALVSGDSYRGVSGTSCSEGHGCSDLNTGLSSPGSRSSFGRPSP

SEQ ID NO: 26297 - protein, 778 aa, Arabidopsis thaliana
MRGVFIVIVTCLVFLPDPLRAGVASIGSITPGFGGSQMNYINNDGIFLESNNSAFGFGFVTTQDSVTLFTLSIIHKSSTKLIWSANRASPVSNSDKFVFDDNGNVVMEGTEVWRLDNSGKNASRIELRDSGNLVVVSVDGTSIWESFDHPTDTLITNQAFKEGMKLTSSPSSSNMTYALEIKSGDMVLSVNSLTPQVYWSMANARERIINKDGGVVTSSSLLGNSWRFFDQKQVLLWQFVFSDNKDDNTTWIAVLGNNGVISFSNLGSGASAADSSTKIPSDLCGTPEPCGPYYVCSGSKVCGCVSGLSRARSDCKTGITSPCKKTKDNATLPLQLNSSGNCFLFDYIGSFKTSGNGGSGFVSYIKIASTGSGGGDNGEDDGKHFPYVVIIVVVTVFIIAVLIFVAFRIHKRKKMILEAPQESSEEDNFLENLSGMPIRFAYKDLQSATNNFSVKLGQGGFGSVYEGTLPDGSRLAVKKLEGIGQGKKEFRAEVSIIGSIHHLHLVRLRGFCAEGAHRLLAYEFLSKGSLERWIFRKKDGDVLLDWDTRFNIALGTAKGLAYLHEDCDARIVHCDIKPENILLDDNFNAKVSDFGLAKLMTREQSHVFTTMRGTRGYLAPEWITNYAISEKSDVYSYGMVLLELIGGRKNYDPSETSEKCHFPSFAFKKMEEGKLMDIVDGKMKNVDVTDERVQRAMKTALWCIQEDMQTRPSMSKVVQMLEGVFPVVQPPSSSTMGSRLYSSFFKSISEDGGATTSSGPSDCNSENYLSAVRLSGPR

SEQ ID NO: 26298 - protein, 841 aa, Brassica rapa
MKGVRNIYHHSYTFLLVFFVMILFRPAFSLSTLSSTESLTISSNRTLVSPGNIFELGFFRTNSRWYLGMWYKKLSGRTYVWVANRDNPLSNSIGTLKISNMNLVLLDHSNKSVWSTNLTRENVRSPVVAELLANGNFVVRDPSGFLWQSFDYPTDTLLPEMKLGYDLKTGLNRFLVSWRSSDDPSSGDFSYKLDIQRGLPEFYTFKDNTLVHRTGPWNGIRFSGIPEEQQLSYMVYNFTENSEEVAYTFLVTNNSIYSRLTINFSGFFERLTWTPSLVIWNPIWSSPASFQCDPYMICGPGSYCDVNTLPLCNCIQGFKPLNVQEWDMRDHTRGCIRRTRLSCRGDGFTRMKNMKLPETTMATVDRSIGVKECEKKCLSDCNCTAFANADIRDGGTGCVIWTGRLDDMRNYAVSGQDLYVRLAAADVVEKRTANGKIVSLIVGVCVLLLLIFFCLWKRKQRRAKAMATSIVHRQRKQILLMNGMTLSNNRQLSRENKTGEFELPLIELEAVVKSTENFSNCNKLGQGGFGIVYKGTLDGQEIAVKRLSKTSVQGADEFMNEVTLIARLQHINLVQILGCCIDADEKMLIYEYLENLSLDSYLFGKTRSSKLNWKERFDITNGIARGLLYLHQDSRFRIIHRDLKVSNILLDKNMIPKISDFGMARIFARDETEANTMRVVGTYGYMSPEYAMEGIFSEKSDVFSFGVIVLEIVTGKRNREFNNENNLLSYAWSNWKEGRALEIVDPDIVDSLSPLSSTFQPQEVLKCIQIGLLCVQELAEHRPTMSSVVWMLGSEATEIPQPKPPGYWVRRSSYELDPSSSKCDDDSWTVNQYTCSVIDAR

SEQ ID NO: 26299 - protein, 847 aa, Brassica rapa
MRSHVPNYHHPYTFFFVFILFPASGVYANTLSPTESLTISNNKTIVSRNETFELGFFTPGSSSRWYLGIWYKKIPTRTYVWVANRDNPLSRPSGSLKISSDNNLVIYDHSDTPVWSTNLTVGASRSPVVAELLDNGNFVLNSNDPEGYLWQSFDFPTDTLLPDMKLGWDKKTGLDRVLRSWKSVEDPASGDYSTKLETRGFPEYYVFNKETIIYRSGPWIGNRFSCVPEMKPIEYMVYTFIASNEEVSYAYHMTKPDVYSTLSLSYTGTIQRRNWIEQAQDWKQLWYQPKDICDNYRQCGNYGYCDSNNLPNCNCIKGFGLENGQEWALRDDSAGCVRKTRLSCDGRDGFVAVKRMKLPDTAATVLDRGIGLKECKAKCLQDCNCTAYANTDIRDGGSGCVIWNGGLFDIRMYPNGGQDIYVKLAAADLDHFKITSHGTIIGSGIGVIILLLLSIIILGYWKRKQKRFITIQTPIVDQVRSQDLLINQVVLTSERYISRENKTDDLELPLMEFEALDMATNRFSVANMLGQGGFGIVYKGMLPDGKEIAVKRLSKMSLQGTDEFKNEVRLIARLQHINLVRLLGCCVDKGEKMLIYEYLENLSLDSHLFDKIRRSNLSWPKRFDITNGIARGLLYLHQDSRFRIIHRDLKASNVLLDKNMTPKISDFGMARIFGREETEANTRKVVGTYGYMAPEYAMDGIFSMKSDVFSFGVLLLEIITGKRSKGFYNSNRDNNLLGFVWRYWKEGKGIEIVDPIIMDSSLSALCTHEILRCIQIGLLCVQERAEDRPVMSTVMVMLGSETTAIPQPKPPGFCVGRSLFETESSSSTQRDDELSVNQITLSVIDAR

SEQ ID NO: 26300 - protein, 849 aa, Brassica oleracea
MRTVSTYYHTYTVVLMFIFLVLILFHAFPVSANTFSATESLTISSNKTILSRSEIFELGFFNPPSSSRWYLGIWYKKVSTRTYVWVANRDNPLLSSNGTLNISDSNLVIFDQSDTPVWSTNLTEGEVRSPVVAELLDNGNFVLRHLNNNNDPDGYLWQSFDFPTDTLLPEMRLGWDHKTGRDRFLRSWKTPDDPSSGDFFTKLKTKGFPEFYVCSKDSIIYRSGPWNGIRFSSSPETKPLDYIVYNFTATNEEVSYSYLITKTNIYERVRLSSAGLLERLTWIETAQSWKQLWYSPKDLCDNYKECGSYGYCDSNTSPICNCIKGFGPGNQQPWTLRDDSAGCVRKTRLSCDGRDGFVRLKKMKLPDTTATTVDRGIGLKECEERCLKDCNCTAFANTDIRNGGSGCVIWTGEIFDIKNFAKGGQDLFVRLAAADLEDKRTKKRNIILGLSIGVSILLLLSFIIFRFWKRKQKQSVAIPKPIVTSQDSLMNEVVISSKRHLSGDMKTEDLELPLMDFEAIATATHNFSSTNKLGQGGFGIVYKGRLLDGKEIAVKRLSKMSLQGTDEFKNEVRLIARLQHINLVRLLGCCVDKGEKMLIYEYLENLSLDSHLFDKSRRSNLNWQLRFDIANGIARGLLYLHQDSRFRIIHRDLKVSNILLDKNMIPKISDFGMARIFRRDETEANTRKVVGTYGYMSPEYAMNGIFSVKSDVFSFGVLLLEIISGKRSTGFYNSSGDLSLLGCVWRNWKERKGLDIIDPIIIDSLSSTFKTHEILRCIHIGLLCVQERAEDRPAMSSVMVMLGSETTTLPEPKQPAFCVGRGPLEAELSKLGDDEWTVNQITLSVIDAR

SEQ ID NO: 26301 - protein, 841 aa, Brassica oleracea
MRSMSNYDRLYTLVLIMLPALSISTNTLSSTESLTVGSNETIVSSGEIFELGFFNLPSSSRWYLGIWYKKIPARAYVWVANRDNPLSNSNGTLRISDNNLVMFDQSGTPVWSTNRTRGDAGSPLVAELLDNGNFVLRHLNNSDQDVFLWQSFDFLTDTLLPEMKLGWDRKTGLNRYLRSWRNPDDPSSGDFSTKLETTRGFPEFYAWNKDEIIYRSGPWSGNRFGSDVLDMKPIDYLGFNFTADNEHVTYSYRITKPDVYSRVILSSAGLLQRFTWFETEQSWRQLWYLPRDLCDDYRECGDYGYCDLNTSPVCNCIQGFETRNNQTAGCARKTRLSCGGKDGFVRLKKMKLPDTTVTVVESGVGLKECEERCLKDCNCTAFANMDIRNGGSGCVIWKGDIFDIRNFPNGGQDLYVRLAAADLVDKRGKRGKIIALSIGVTIFLLLCFIIFRFWKKKQKRSIAIQTPIVDQGRIEDSLMNELAITSRRYISRENKTDDDLELSLMEFEVVALATNNFSSANKLGRGGFGTVYKGRLLDGKEIAVKRLSKMSLQGTDEFKNEVKLIARLQHINLVRLIGCCIDKGEKMLIYEYLENLSLDSHIFDITRRSNLNWQMRFDITNGIARGLVYLHRDSRFMIIHRDLKASNVLLDKNMTPKISDFGMARIFGRDDAEANTRKVVGTYGYMSPEYAMDGIFSMKSDVFSFGVLLLEIISGKKNNGFYNSNQDLNLLALVWRKWKEGKWLEILDPIIIDSSSSTGQAHEILRCIQIGLLCVQERAEDRPVMASVMVMIGSETMAIPDRKRPGFCVGRNPLEIDSSSSTQGNDECTVNQVTLSVIDAR

SEQ ID NO: 26302 - protein, 857 aa, Brassica oleracea
MKGVRNIYHHSYTSILLVFVVMILFHPAFSIYINTLSSADSLTISSNRTLVSPGNIFELGFFRTTSSSRWYLGMWYKKLSDRTYVWVANRDNPLSNSIGTLKISGNNLVILGDSNKSVWSTNITRGNERSPVVAELLANGNFVMRDSNNNDGSGFLWQSFDYPTDTLLPEMKLGYDLITGLNRFLTSSRSLDDPSSGDYSYKFESRRLPEFYLLKGSGFRVHRSGPWNGVQFSGMPEDQKLSYMVYNFTQNSEEVVYTFRMTNNSIYSRLTISSEGYLERLTWTPSSGMWNVFWSSPVDLQCDVYKICGPYSYCDVNTSPVCNCIQGFNPLNVHQWDLRDGTSGCIRRTRLSCSGDGFTRMKNKKLPETTMAIVDHSIGLKECKKWCLSDCNCTAFANTDIRNGGTGCVIWTERLEDIRTYFTDGQDLYVRLAAADLVKKRNANGKIASLIVGASVLLLLIMFCLWKRKQNRVKASAISIANRQRNKNLPMNGMVLSSKKQLRRGNKTEELELPLIELEAVVKATENFSNCNKLGEGGFGIVYKGRLLDGQEIAVKRLSKTSVQGTDEFMNEVTLIARLQHINLVQIFGCCIQADEKMLIYEYLENSSLDSYLFGKTRSSKLNWKERFEITNGVARGLLYLHQDSRFRIIHRDLKVSNILLDKNMIPKISDFGMARIFAREETEANTMKVVGTYGYMSPEYAMHGIFSEKSDVFSFGVIVLEIVTGKRNRVFYNLNYEDNLLNYAWNNWKEGRALEIVDPAILDSLSSLPSTFQPQDVLKCIQIGLLCVQDLAENRPTMSSVVWMLGSEATEIPQPKPPGYCLVRSPYEPDPSSNRQREDDESWTVNQYTCSVIDAR

SEQ ID NO: 26303 - protein, 850 aa, Brassica oleracea
MQGVRYIYHHSYTLLVFVVMILFRPALSIYVNTLSSTEYLTISNNKTLVSPGDVFELGFFKTTSSSRWYLGIWYKTLSDRTYVWIANRDNPISNSTGTLKISGNNLVLLGDSNKPVWSTNLTRRSERSPVVAELLANGNFVMRDSNNNDASQFLWQSFDYPTDTLLPDMKLGYDLKTGLDRFLTSWRSLDDPSSGNFSYRLETRKFPEFYLRSGIFRVHRSGPWNGIRFSGIPDDQKLSYMVYNFTDNSEEVAYTFRMTNNSIYSRLTVSFLGHFERQTWNPSLGMWNAFWSFILDSQCDIYKMCGPYAYCDVNTSPICNCIQGFNPSDVEQWDRRSWAGGCIRRTRLSCSGDGFTRMKNMKLPETTMAIVDRSIGVKECEKKCLSDCNCTAFSNADIRNGGMGCVIWTGRLDDMRNYAADGQDLYFRLAAVDLVKKRNANWKIISLTVGVTVLLLLIMFCLWKRKQKRAKANATSIVNRQRNQNLPMNGMVLSSKTEFSEENKIEELELPLIDLETVVKATENFSNCNKLGQGGFGIVYKGRLLDGKEIAVKRLSKTSVQGTDEFMNEVTLIARLQHINLVQIIGCCIEADEKMLIYEYLENLSLDSFLFGKTRRSKLNWKERFDITNGVARGLLYLHQDSRFRIIHRDLKVSNILLDKNMIPKISDFGMARMFAREETEASTMKVVGTYGYMSPEYAMHGIFSEKSDVFSFGVIVLEIVTGKRNSGFNNLNYEDHLLNYAWSHWKEGKALEIVDPVTVDSLPSTFQKQEVLKCIQIGLLCVQELAENRPTMSSVVWMLGSEATEIPQPKPPGYCIRRSPYELDPSSSRQYDNDEWTVNQYTCSFIDAR

SEQ ID NO: 26304 - protein, 850 aa, Brassica oleracea
MRIFRKTLVSFPLFIFLFLYESSTAQDTIRRGGFLRDGSTHKPLVSPQKTFELGFFSPGSSPGRYLGIWYGNIEDKAVVWVANRENPISDRSGVLTISNDGNLVLLNGQNITVWSSNITSTNNDNNRVGSILDTGNFELIEVSSERVIWESFNHPTDTFLPHMRVRVNPQTGDNLAFVSWRSENDPSPGNFSLGVDPSGAPEIVLWGRNNTRRWRSGQWNSAIFTGIPNMALLTNYLYGFKLSSPPDETGSVYFTYVPSDPSVLLRFKVLHNGTEEELRWNETSKRWTKFQAAPESECDKYNRCGSFGICDMRGDNGICSCVKGYEPVSLGNWSRGCRRRTPLRCERNVSNVGEDEFLTLKSVKLPDFETPEHSLADPEDCKDRCLKNCSCTAFTFVNGIGCMIWNQDLVDLQQFEAGGSSLHVRLADSEIGESKKTKIVVIVAVLVGVLLLGIFALLLWRFKRKKDVSGTYCGHDADTSVVVVDMTKAKDTTTAFTGSVDIMIEGKAVNTSELPVFCLKVIVKATNDFSRENELGRGGFGPVYKGVLEDGQEIAVKRLSGKSGQGVDEFKNEIILIAKLQHRNLVRLLGCCFEGEEKMLVYEYMPNKSLDFFIFDEMKQELVDWKLRFAIIEGIARGLLYLHRDSRLRIIHRDLKVSNVLLDGEMNPKISDFGMARIFGGNQNEANTVRVVGTYGYMSPEYAMEGLFSVKSDVYSFGVLLLEIISGKRNTSLRASEHGSLIGYAWFLYTHGRSEELVDPKIRATCNKREALRCIHVAMLCVQDSAAERPNMAAVLLMLESDTATLPVPRQPTFTTSTRRNSMDVNFALDSSQQYIVSSNEITSTVVLGR

SEQ ID NO: 26305 - protein, 684 aa, Treponema pallidum subsp. pallidum
MLRAMRTIPPITGIIASAGCAIGPVFCFDTLLPTRSRPGGSRLRPPSQEIARLRNALSYARASLQNLLDSVRAKASGDEPAPEYAVLSGQAEMLADAAFIATVEETLRSCSCDAETALRKAITHVTDALSATSDEYLRARAADIRDAFSGVFDALAHDTTPTAGSSLPTQGIGNSTPHSPWELTLAPFPQDPSWLPLTYNLRTHCACTRQISLVWTEGGSVTSHVAIMARAWSLPLLVSAQGCKDVAQYVLRVRQTARATDEALRALLDAESSGGKTDALGTLTVNPDVRALRTRMPHPFLTVKHTSTAEQSPPAACVLNAPLRTYSSDGIRFEVGANIVMPQEACAAAALGAAGIGLFRSEFLLFGSDRFPDEETQCSAYTRALQAMRGLPVVLRTFDLGADKLVPDPARMCALSDAAEPCAHTASERNPLLGLRGIRYCLAHPELLKVQLRAMLRAGACATCAEGTLRILIPMVSRVEEIHAVADLISEVADECARAHVSTPDRVALGIMIETPASALMAADFAPHVDFFSIGTNDLTQYVFAADRENEQVSSYADYFHPALLRLIQHVIHAHRHLRQRPGISFGEQGIGRVVMCGAMAEDETALFLLAGLGLRALSVPSSRIETLHTFLSRISVSDAEHCARAAVQLSDAQSVRTLIEEHLRTAGITLEKDEEEPSPPRSP

SEQ ID NO: 26306 - protein, 622 aa, Xanthomonas campestris pv. campestris
MANERPAQQSDIKLLISKGLEQGYLTYAEVNDHLPDDLVDPEQIEDIISMINGMGIDVHEVAPDAETLLLNDGNTGNREVDDTAAEAAAAALTALDTEGGRTTDPVRMYMREMGTVELLTREAEIAIAKRIEEGLSQVQAALGTFPLVDRAAAVRLRSAQGRQEAPGRDRGRLQRPDRRSRRCRCSLAAAGRSPLTKMRWTKTQTKTAMTTLPRKKSGPTVRTRWKLPRAWRTWPTSTPSSRRPYVKYGAEHKNVAKAREDMAAIFTTLNVPLTDALVTQLRGVVNGIKDHERKVLHLATTVARMPRKDFIRSWEGNQTNLEWVEDALKRKQKWSSALRDVKDQIVSEQQGSIEMEKANYLTLAEIKDISRAMAYGEAKARKAKKEMVEANLRLVISIAKKYTNRGLQFLDLIQEGNIGLMKAVDKFEYRRGYKFSTYATWWIRQAITRSIADQARTIRIPVHMIETINKLNRISRQMLQQFGREPTPEELAKEMDMPEDKIRKVMKIAKEPISMETPIGDDEDSHLGDFIEDTNVESPIDNTTNINLSETVRDVLAGLTPREAKVLRMRFGIDMNTDHTLEEVGKQFDVTRERIRQIEAKALRKLRHPSRSEQLRSFLDID

SEQ ID NO: 26307 - protein, 424 aa, Cyanidium caldarium
MALTSLGPLPDSFSSVSSLASAPRVPLFKDELRPFIEDDANDDDEEGGLVAQEQATMKPRRRAKTSTTCAATAYVREICRLDRLTDEEVASLSMATQDYCALMKQREELCAKLGREPTDTEWSTTVGVSEEEVRKRIERGRRARERLVASNLRLVLAIANRYKLRAVVCSAWKSRSKGGMDMPSHEKVRLQRQHNIFLGDLIQEGALGLIRAAEKFDPSKGFKFSTYATWWIRQAIQRCVSEHSRTIRLPNHVTESLRQIYRMRARLQHVLKRPPTDEEVAEACNMTLKRLKKITQHAWETQTLSLEGPPNSEAHSLYKSQQGEAPLSIGSIIEATEETPEEALERNCMREDVECVLRTLPFQEREILRLRYGISDDERPHSTEELSARFQLPVHTIRLIESRALRKLRHPSLAAMLREYVNIL

SEQ ID NO: 26308 - protein, 947 aa, Oryza sativa; identical to SEQ ID NO: 3539

SEQ ID NO: 26309 - protein, 254 aa, Solanum tuberosum
MAREENVYMAKLAEQAERYEEMVQFMEKVSTSLGSEELTVEERNLLSVAYKNVIGARRASWRIISSIEQKEESRGNEEHVKCIKEYRSKIESELSNICDGILKLLDSNLIPSASNGDSKVFYLKMKGDYHRYLAEFKTGAERKEAAESTLSAYKAAQDIANTELAPTHPIRLGLALNFSVFYYEILNSPDRACNLAKQAFDEAIAELDTLGEESYKDSTLIMQLLRDNLTLWTSDMQDDGADEIKETKPDNEQQ

SEQ ID NO: 26310 - protein, 249 aa, Lycopersicon esculentum
MALPENLTREQCLYLANVAEQAERYEEMVKFMDKLVIGSGSSELTVEERNLLSVAYKNVIGSLRAAWRIVSSIEQKEEGRKNDEHVVLVKDYRSKVESELSDVCAGILKILDQYLIPSASAGESKVFYLKMKGDYYRYLAEFKVGNERKEAAEDTMLAYKAAQDIAVADVAPTHPIRLGLALNFSVFYYEILNASEKACSMAKQAFEEAIAELDTMGEESYKDSTLIMQLLRDNLTLWTSDMQEQMDEA

SEQ ID NO: 26311 - protein, 138 aa, Lycopersicon esculentum
MAALIPENLSREQCLYLAKLAEQAERYEEMVQFMDKLVLNSTPADDLTVEERNLLSVAYKNVIGSLRAAWRIVSSIEQKEESRKNEEHVHLVKEYRGKVENELSQVCAGILKLLESNLVPSATTSESKVFHLKMKGDY

SEQ ID NO: 26312 - protein, 254 aa, Lycopersicon esculentum
MAREENVYMANVAEQAERYEEMVQFMEKVSTSLGSEELTVEERNLLSVAYKNVIGARTLAWRIISSIEQKEESRGNEEHVKCIKEYRSKIESELSDICDGILKLLDSNLIPSASNGDSKVFYLKMKGDYHRYLAEFKTGAERKEAAESTLSAYKAAQDIANTELAPTHPIRLGLALNFSVFYYEILNSPDRACNLAKQAFDEAIAELDTLGEESYKDSTLIMQLLRDNLTLWTSDMQDDGADEIKETKNDNEQQ

SEQ ID NO: 26313 - protein, 258 aa, Lycopersicon esculentum
MAFAREENVYMANVAEQRRSYEEMVEFMEKVVAAADGAEELTVEERILLSVAYKNVMGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTSWTSDMQDDGTDEIKEATPKPDDNE

SEQ ID NO: 26314 - protein, 131 aa, Lycopersicon esculentum
MASSKERESLVYIARLAEQRERYDEMVDAMKNVANLDVELTVEERNLLSVGYKNVVGSRRASWRILSSIEQKEDASGNEQNVKRIQGYRQKVESELTDICNNIMTVIDEHLIPSCTAGESTVFYYKMKGDY

SEQ ID NO: 26315 - protein, 131 aa, Lycopersicon esculentum
MASSKERENFVYVAKLAEQAERYDEMVEAMKNVANMDVELTVEERNLLSVGYKNVVGSRRASWRILSSIEQKEESRGNEQNVKRIKEYLQKVESELTNICNDIMVVIDQHLIPSCSAGESTVFYHKMKGDY

SEQ ID NO: 26316 - protein, 263 aa, Hordeum vulgare
MSAPGELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 26317 - protein, 262 aa, Oryza sativa; identical to SEQ ID NO: 951

SEQ ID NO: 26318 - protein, 256 aa, Oryza sativa; identical to SEQ ID NO: 3308

SEQ ID NO: 26319 - protein, 265 aa, Oryza sativa; identical to SEQ ID NO: 3563

SEQ ID NO: 26320 - protein, 245 aa, Mus musculus
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDDAEAGEGGEN

SEQ ID NO: 26321 - protein, 585 aa, Solanum tuberosum
MSKQSYRVCFCFRRRFRVLAAEAPADVKNLFNRYSDNGVMSAENLHRFLIEVQKEENATLEDAHAIMNNLHDLKILNIFHRRGLHLDAFFKYLFADINPPLNSKLGIHQDMNAPLSHYFIYTGHNSYLTGNQLSSDCSDVPIIQALHRGVRVIELDIWPNSAKDDVEVLHGGTLTTPVALIKCLKSIKEHAFTVSEYPVVITLEDHLTTDLQAKTAEMITQTFGDMLFSSDSCLKEFPSPESLKRRVLISTKPPKEYLQAKEVNETGAMKGTDQTDTEAWGREVSDIKARYNDKDDSDEGEADDSDEEDPTSQQNTAPEYRRLIAIHAGKGKGGLSDWLRVDPDKVRRLSLSEQELGKAVVTHGKEIIRFTQRNILRIYPKGIRFDSSNYNPFNAWTHGAQMVAFNMQGYGRSLWLMHGMFRGNGGCGYVKKPDILLKAGPNNEVFDPEANLPVKTTLKVTVFMGEGWYYDFEHTHFDAYSPPDFYARIGIAGVDADIVMKKTKTLEDNWIPTWDEQFEFPLTVPELALLRVEVHEYDMSEKDDFAGQTCLPVSELRQGIRAVPLHNRKGEKYNSVKLLLRFEFI

SEQ ID NO: 26322 - protein, 549 aa, Vigna unguiculata
MATHNYKVFSCFNRKFTITEPKPPPDVQKAFSEFSDGASSMSAEHLLRFLAEHQGEVDCTVSDSEQILQQSRKEDGETGFDLHDFFHFLQENDLNVPLKSQVHHDMNAPISHYFIYTGHNSYLTGNQLSSDCSDAPIIKALQRGVRVIELDLWPNSNKDDIDVVHGRTLTTPVSLLRCLKSIKEYAFVKSQYPLVITLEDHLTPDLQAKVAKMATQVFGELLHYPQTDSLTEFPSPESLKGRILISTKPPKEFLESSEKESAEEVSSLRENADEQRTDNKRAPEYKRLITIHAGKPKGEIQDELKAAGNVRRLSLSEQALEKASESYGADVVRFTHNNILRVYPKGTRLNSSNYKPHIGWTYGAQMVAFNMQGHGKSLWYMQGMFRSNGGCGYVKKPNFLIQKGPQDEVFDPKIALPVKKTLKVKVYLGKGWSLDFSPSDFDSYSPPDFYVKVCIVGVPADMIKKKTSVISNNWFPVWNEEFDFPLTVPELALLGIEVREDDKHQKDDFGGQTCLPVSELKSGFRSVPLYDEKGDKYKSVKLLMRFQFR

SEQ ID NO: 26323 - protein, 396 aa, Umbelopsis vinacea
MLSNTQILTILGLSVVQVMGIIDPSLAKTPQMGWNSWNKYQCNVNETVIINTANAMVSSGLKDLGYHYINIDDCWSLHQRDNTTQRIAPDPTKFPNGISGVASKVHALGLKFGIYSDAGTNTCAGYPGSYGYEAIDAQAFSDWGVDYLKYDNCNNLGLAGNATISSKRYKRMGDALKNVSRPIFFSLCSWGTDDVWDWGRSIGGQSWRMSGDISDNWSSVVSITGQAVPIANISAPGGWNDMDMLEVGVHDQMTITEYTSHFSIWAAMKSPLILGNDITNMTNDIKNIITNNEVIAISQDSLGASVQQRSMKGNTQLFAGPLSKNGYVSLFLNEGNSTTNMTGTWSEIFNNPKANTHKSIAVRDLWAHKDLGRFQGSISVSVESHGVRMLKFSQQA

SEQ ID NO: 26324 - protein, 159 aa, Hordeum vulgare
GTTPTCWRWGNGGMTNDEYIVHFSIWAISKAPLIIGCDVRHMSQDTYDILANKEVIAVNQDPLGVQGKKVRMEGSSEIWAAPLTGYRTAVLLLNRHAKDEAQITAHWDDIGLPAGTAVEARDLWLHKTLEPKFTDKMSFNVTPHAARMFVLTPLKSQLD

SEQ ID NO: 26325 - protein, 204 aa, Hordeum vulgare
SLCEWGNENPATWARGMGGNSWRTTGDIADNWGSMTSRADQNDRWASYAGPGGWNDPDMLEVGNGGMSEAEYRSHFSIWALAKAPLLIGCDVRSMTPQTKTIISNQEVIAVNQDRLGVQGKKVQSDGGLEVWAGLLSGNRKAVVLWNRQGYQATITAHWSNVGLPASASVTARDLWAHSSFSAQGQLSASVGPHDCKMYILTPK

SEQ ID NO: 26326 - protein, 597 aa, Homo sapiens [sequence omitted]

SEQ ID NO: 26327 - protein, 294 aa, Vigna radiata
EHPQFTKNDFYITGESYAGHYIPALASRVHQGNKAKEGIHINLKGFAIGNGLTNPEIQYQAYTDYALDRGLIQKADYNSINKLLPSCKQAIEDCGTEGGETCVTSLYVCNKIFNRIMNIAGDVNYYDIRKKCVGDLCYDFSEMEEFLNKKTVRDALGVGDLDFVSCSSTVYSAMMEDWMRNLEAGIPALLEDGIKVLVYAGEEDLICNWLGNSRWVQAMEWSGQKEFGASGAVPFLVDGAEAGTLKSHGPLAFLKVYEAGHMVPMDQPKAALTTLRSWMQGKLTMTKNGDKRLS

SEQ ID NO: 26328 - protein, 101 aa, Vigna radiata
WLTGAPGCSSELALFYENGPFQLTKNLSLVWNDYGWDKASNIIFVDQPTGTGFSYTSDESDIRHDEEGVSNDLYDFLQAFFKEHPQFTKNDFYITGESYAG

SEQ ID NO: 26329 - protein, 771 aa, Oryza sativa
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 26330 - protein, 767 aa, Oryza sativa; identical to SEQ ID NO: 3375

SEQ ID NO: 26331 - protein, 766 aa, Vigna radiata
MGAAILPDLGTEILIPVCAVIGIAFALFQWLLVSKVKLSAVRDASPNAAAKNGYNDYLIEEEEGINDHNVVVKCAEIQNAISEGATSFLFTEYKYVGIFMVAFAILIFLFLGSVEGFSTSPQACSYDKTKTCKPALATAIFSTVSFLLGGVTSLVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGLNHELTAMLYPLIVSSVGILVCLLTTLFATDFFEIKAVKEIEPALKKQLVISTVLMTIGVAVVSFVALPTSFTIFNFGVQKDVKSWQLFLCVAVGLWAGLIIGFVTEYYTSNAYSPVQDVADSCRTGAATNVIFGLALGYKSVIIPIFAIAISIFVSFTLAAMYGIAVAALGMLSTIATGLAIDAYGPISDNAGGIAEMAGMSHRIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKIF

SEQ ID NO: 26332 - protein, 761 aa, Beta vulgaris
MISDLATEIFIPVCAVIGYISCYQWFLVSKVKVSTDRHVNNGGSAKNGFNDYLIEEEEGVNDQNVVAKCAEIQNAISEGATSFLFTEYQYVGVFMCAFAVLIFVFLGSVEGFSTESQPCTYSPLKKCKPALATALFSTVSFLLGAITSVVSGFLGMKIATDANARTTLEARKGVGKAFIIAFRSGAVMGFLLAANGLLVLYIAINLLKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEFTAMCYPLLISSMGIIVCLVTTLFATDFFEIKAVKEIEPALKKQLIISTVLMTVGIAIITWIALPSSFTIFNFGTQKVVHNWQLFLCVCVGLWAGLIIGFVTEYYTSNAYSPVQDVADSCRTGAATNVIFGLALGYKSVIIPIFAIAVSIFVSFSFAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARSLGPKGSEPHKAAVIGDTIGDPLKDTSGPSLNILIKLMAVESLVFAPFFATHGGLLFKLF

SEQ ID NO: 26333 - protein, 765 aa, Beta vulgaris
MGAALLPDLITEIIIPVCAVIGIAFSLLQWYIVLRVKLSPDSTRNNNNKNGFSDSLIEEEEGLNDQSVVAKCAEIQNAISEGATSFLFTEYQYVGIFMVAFAVLIFLFLGSVEGFSTSSQECTYDKTRRCKPALATAIFSTVAFLLGAITSLGSGFFGMKIATYANARTTLEARKGVGKAFIVAFRSGAVMGFLLAANGLLVLYITILLFKIYYGDDWEGLFEAITGYGLGGSSMALFGRVAGGIYTKAADVGADLVGKVERDIPEDDPRNPAVIADNVGDNVGDIAGYGVLIFLDSYAESSCAALVVRSISSFGISHDLTAMMYPLLVSSVGIIVCLITTLFATDFFEIKAVKEIEPALKKQLIISTALMTVGVAVISWIALPTSFTIFDFGSQKEVQNWQLFLCVAVGLWAGLIIGFVTEYYTSNAYSPVQDVADSCRTGAATNVIFGLALGYKSVIIPIFAIAISIFVSFSFAAMYGIAMAALGMLSTIATGLAIDAYGPISDNAGGIAEMAGMSHRIRERTDALDAAGNTTAAIGKGFAIGSAALVSLALFGAFVSRASIQTVDVLTPKVFIGLIVGAMLPYWFSAMTMKSVGSAALKMVEEVPKQFNTIPGLLEGTAKPDYATCVKISTDASIKEMIPPGALVMLTPLIVGTFFGVETLSGVLAGSLVSGVQIAISASNTGGAWDNAKKYIEAGASEHARTLGPKGSDAHKAAVIGDTIGDPLKDTSGPSLNILIKLMAVESLVFAPFFATHGGLLFKYL

SEQ ID NO: 26334 - protein, 496 aa, Nicotiana tabacum
MVLSKTASESDVSVHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLEKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVLAYTMPPNAQHVTVLRVVIREDFSRTLAERLVIDIEKVFHGVDTLPARVNAKLAVAEANGSGVHKKTDREVQLEITTAWLKFVADKKKKTNGVC

SEQ ID NO: 26335 - protein, 433 aa, Nicotiana tabacum
MAGQTVIVSGLNPAAILQSTIGGGASPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVNKIRKHHPKSELLLRIKPMLDGNARCPMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFALATTIIGKRVRGELREYWINDGLYGSMNCVLYDHATVNATPLAVLSNRSNVTCGGSKKFPTTVFGPTCDAFDTVLRDYQLPELQVNDWLVFPNMGAYTKAAESNFNGFNNSAIVTHLAYFYPS

SEQ ID NO: 26336 - protein, 433 aa, Nicotiana tabacum
MAGQTIIVSGLNPAAILQSTIGGGASPTAAAAAENGTRKVIPLSRDALQDFMLSIITQKLQDEKQPFYVLDLGEVVSLMDQWKSALPNIRPFYAVKCNPEPSFLSILSAMGSNFDCASRAEIEYVLSLGISPDRIVFANPCKPESDIIFAAKVGVNLTTYDSEDEVYKIRKHHPKSELLLRIKPMLDGNARCPMGPKYGALPEEVDPLLRAAQAARLTVSGVSFHIGSGDADSNAYLGAIAAAKEVFETAAKLGMSKMTVLDVGGGFTSGHQFTTAAVAVKSALKQHFDDEPELTIIAEPGRFFAETAFTLATTIIGKRVRGELREYWINDGLYGSMNCVLYDHATVNATPLAVLSNRSNVTCGGSKTFPTTVFGPTCDALDTVLRDYQLPELQVNDWLVFPNMGAYTKAAGSNFNGFNTSAIVTHLAYSYPS

SEQ ID NO: 26337 - protein, 495 aa, Mycobacterium leprae
MPGQSSGYCQRAGDPRSQCSGADVNVHTAGPRHAEKTRHTATPQRVQPSDDLLRLASNVWPRNITRDETGVACIAGNKLTDLAGEYGTPLFVIDEDDFRFRCREIAAAFGGGENVHYAAKAFLCTEIARWIDEEGLSLDVCSGGELAVALHASFPPERISLHGNNKSVAELKDAVKAGVGYIVLDSTTEIERLDAIAGEAGIVQDVLVRLTVGVEAHTHEFIATAHEDQKFGLSVASGAAMAAVRRVFATDNLRLVGLHSHIGSQIFDVAGFELAAHRVIGLLCDIVGEFDPEKTAQLSIVDLGGGLGISYLPDDDPPPIFELAAKLGAIVSNESAAVGLPVPKLMVEPGRAIAGPGTITLYEVGTIKDVDVSATAHRRYVSIDGGMSDNIRTALYDAQYDVRLVSRTSDAPAAPASIVGKHCESGDIVVRDTWVPDDLKPGDLVGVAATGAYCYSLSSRYNMLGRPAVVAVCAGQARLILRRETVDDLLSLEVR

SEQ ID NO: 26338 - protein, 278 aa, Nicotiana tabacum
MVRAPCCEKMGLKKGPWIPEEDQILISFIQTNGHGNWRALPKQAGLLRCGKSCRLRWTNYLRPDIKRGNFTKEEEETIIQLHEMLGNRWSAIAAKLPGRTDNEIKNVWHTHLKKKLKDYKPPQNSKRHSKSKNHDSKGPTTSESSNNSDLTIINTQKHIDSPVLAPNSPQISSSTEMSTVTLVDDHQMVVIKQEVMESSEYFPEIDESFWTDELTTDNNWSSTDHVMVAANQELQVQLPFSSFKEENVDILATKMEDDMDFWYNVFIKTDDLPELPEF

SEQ ID NO: 26339 - protein, 217 aa, Pisum sativum
MDKKPCNSSQDPEVRKGPWTMEEDLILINYIANHGEGVWNSLAKAAGLKRTGKSCRLRWLNYLRPDVRRGNITPEEQLLIMELHSKWGNRWSKIAKHLPGRTDNEIKNFWRTRIQKHIKQVDNPNQQNFQQKMSLEINDHHHHHPHQPSSSQVSNLVEPMETYSPTSYQGTLEPFPTQFPTINNDHHQNSNCCANDNNNNNYWSMEDIWSMQLLNGD

SEQ ID NO: 26340 - protein, 469 aa, Glycine max; identical to SEQ ID NO: 2208

SEQ ID NO: 26341 - protein, 493 aa, Nicotiana tabacum
MRHANIKHGSFHLEEHNMRITRARARVSGSSGRLPPLHPSTKQDKKQALGAESKRSKRSASDENRPGTSSIATGVQPKRRAVLKDMKNVLHENSHMNCINGSKIQVKKGSDKRNNKAKPAVSLKLSQLQEKGKEDIADKVKKVKVEGSQEISSGANCKEDMLPQLSRDVTPAQCGLVHLVPVNRSSCKAFPLQNVMKKDESKVCQKQEGFANLGIADIDSRHKDPLMCSLYAPDIYNNLHAIEFDRSPSVDYLEKLQLDINKGMRGILIDWLVEVSEEYRLVPDTLYLTVNLIDRFLSENYIEKQKLQLLGVTCMLIASKFEEICAPRVEEFCFITDNTYSKEEVIKMESRVLNLLSFQLASPTTKKFLRRFIQAAQASYKVPSVELEFMANYLAELTLVDYGFLKFLPSLTAASAVFLARWTLDQSNHPWNPTLEHYTRYKVSELRTTVFALQELQMNTSGCTLNAIREKYRQPKFKSVATLAASKPVQSLF

SEQ ID NO: 26342 - protein, 452 aa, Medicago sativa
MKEVAPGTQDQKQPLRANSKRALSDVTYLPHKKRAILQDVTNNCGVNTKRSCLNPTEIQAKKRKVAKPAQPHVSNEVPSAAELPPFIADSKPVSSMEMRLRSSEDFRCLDDLEDNAPFRMSSNQCGTNNNLLQSQTSRISARPLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLSLTVYLIDWFLSKNCIERERLQLLGITCMLIATKYEEINAPRIKDFCFIQDNTYTKEEVVKLESLVLKSSSYQLFAPTTKTFLRRFLRAAQASYKRPSIELEYLANYLAELTLMNYGFLNFLPSMVAASSVFLARWTLDQSSHPWNPTLEHYASYKASDLKATVLALQDLQLNSNDDCPLTTIRKKYTQDKLNCVAALSSPKLLETLF

SEQ ID NO: 26343 - protein, 443 aa, Petroselinum crispum
MASIPVVQQNRVEAAGGGAVKQKNMAAVEGRNRRALGDIGNLVTGHGIEGKQQQIPQVSRPVTRGFCAQLLANAQAGVVENNKKQRAIVGDGVVAVRQKKVSVKPKPEDIIVISPDTEEADRVNKHLNRKKATEGSLKKKGQTFTSTLTARSKAAAFGLTRKPKEQIVDIDAADANNELAAVEYVEDMYKFYKLAEHESRVFDYIDFQPEINQKMRAILVDWLIEVHNKFELMPETLYLAINILDRYLSTESVARKELQLVGISSMLTASKYEEIWPPEVNDLTKISDNAYTNQQVLIMEKKILGQLEWNLTVPTPYVFLVRFIKASIPNEPAVENMACFLTELGMMNYATVTYCPSMVAASAVYGARCTLDKAPFWNETLKSHTGFSEEQLMECGRTLVRFHSCATENKLRVIYRKYSLDERGCVAMLPPAKALLTVAKPQT

SEQ ID NO: 26344 - protein, 446 aa, Chenopodium rubrum
MAARAVLQEQPRGGVQQKNGQGGERRNRTALGDIGNVVTARGGAIGAANGIAKPQAINRPLTRSFCAQLVANAQAAAEKKKKQGVKAVDVNVGGARKAGVGVAVAPAAAAQKKVQEKKKTEVVVAETKTPSGHGKVEQKPASKKKKTPTFTSFLTARSKEACGLSKKPQELIVNIDEGSVEDELAVVEYVEDIYSFYKIAEDESRVRDYMDSQPDINEKMRSILVDWLIEVHYKFELRQETLYLTINIIDRFLSMKIVPRKELQLVGIASMLIACKYEEIWAPEVNDFVQISDKAYVREQVLCMEKTILGNLEWYLTVPTPYMFLTRYVKASVTLDSEMENMSYFFSELGMMNYSTTIKYPPSLLAASSVYTARCTLNNSPSWTETLKHYTGYSENQLLECARLLVSFHMAAPEGRLRAVYKKFSKPDNGAVALRPPAKSLLASTS

SEQ ID NO: 26345 - protein, 146 aa, Vicia faba
MGFTEKQEALVNSSWELFKQNPGNSVLFYTIILKKAPTAKGMFSFLKDSAGVVDSPKLQAHAEKVFGMVRDSAVQLRASGEIVLGDATLGAIHIQKGVLDPHFVVVKEALLETIKEISGDKWSEELSAAWEVAYEGLAVAIKKAMS

SEQ ID NO: 26346 - protein, 73 aa, Vicia sativa
KGKVDVADDVTLEYLGSVHVQKGVIDLHFMVFKKAMLKTIKMAVEDKWSEELDCAWGKAYDELAAAIKKAMGW

SEQ ID NO: 26347 - protein, 107 aa, Vicia faba
KGMFSFLKDSAGVVDSPKLQAHAEQVFGMVRDSAIQIRQTGDVFLKDGSLGAIHIQKGVVDPHFVVVKEALLKTIKEASGDKWSEELSIAWEVAYDGLATAIKKAMS

SEQ ID NO: 26348 - protein, 83 aa, Vicia faba
QVFGMVRDSAIQLRTTGDIVLKDGTLGAIHIQKGVVDPHFVVVKEALLKTIKEASGDKWSEELSIAWEVAYDGLATAIKKAMS

SEQ ID NO: 26349 - protein, 161 aa, Glycine max; identical to SEQ ID NO: 2018

SEQ ID NO: 26350 - protein, 147 aa, Vicia faba
MGFTDKQEALVNSSWESFKQNLSGNSIFFYTIILEKAPAAKGLFSFLKDTAGVEDSPKLQAHAEQVFGLVRDSAAQLRAKGEVVLGNATLGAIHVQKGVTDPHFVVVKEALLQTIKKASGSNWSVELSTAWEVAYDGLASAIKKAMN

SEQ ID NO: 26351 - protein, 123 aa, Oryctolagus cuniculus
MAGGKAGKDSGKAKAKAVSRSQRAGLQFPVGRIHRHLKTRTTSHGRVGATAAVYSAAILEYLTAEVLELAGNASKDLKVKRITPRHLQLAIRGDEELDSLIKATIAGGGAIPHIHKSLIGKKG

SEQ ID NO: 26352 - protein, 129 aa, Bufo gargarizans
MSGRGKQGGKVRAKAKTRSSRAGLQFPVGRVHRLLRKGNYAQRVGAGAPVYLAAVLEYLTAEILELAGNAARDNKKTRIIPRHLQLAVRNDEELNKLLGGVTIAQGGVLPNIQAVLLPKTESSKPAKSK

SEQ ID NO: 26353 - protein, 139 aa, Pinus taeda
MAGRGKAVGGAGGSKKSTSRSSKAGLQFPVGRIARFLKAGKYAERVGGGAPVYLAAVLEYLAAEVLELAGNAARDNKKTRIVPRHIQLAVRNDEELSKLLGAVTIANGGVMPNIHNILLPKKTASSGAPTKSGKDDEEN

SEQ ID NO: 26354 - protein, 161 aa, Hordeum vulgare
MADVEYRCFVGGLRWATDDQSLQNAFSKYGDVIDSKIITDRETGRSRGFGFVTFASDEAMRQAIEAMNGQDLDGRNITVNEAQSRRSDGGGGFGGGGGGYGGQRREGGGGGYGGGGGGYGGGRSGGGGGYGSRDGGGGGYGGGGGGYGGSRGGSGGGNWRE

SEQ ID NO: 26355 - protein, 165 aa, Nicotiana sylvestris
MAEVEYRCFVGGLAWATTDRTLGEAFSQYGEVLESKIINDRETGRSRGFGFVTFGDEKSMRDAIEGMNGQDLDGRNITVNEAQSRGSGGGGGGGGFRGGRREGGGGYGGGGYGGGRREGGGGGYGGGGYGGGRDRGYGGGDRGYGGDGGSRYSRGGGDSDGNWRN

SEQ ID NO: 26356 - protein, 165 aa, Oryza sativa
MAAPDVDYRCFVGGLAWATDNRSLEAAFSTYGEILESKIINDRETGRSRGFGFVTFSSEQAMRDAIEGMSGKELDGRNITVNEAQSRRSGGGGGGGYGQRGGGGGYGGRGYGGGGGGGGYGQRREGGYGGGGGYGGGGGGGGYGGGYGGGYGSRGGGNSDGNWRN

SEQ ID NO: 26357 - protein, 150 aa, Oryza sativa; identical to SEQ ID NO: 4050

SEQ ID NO: 26358 - protein, 160 aa, Oryza sativa
MAAPDVEYRCFVGGLAWATDDRSLEAAFSTFGEILESKIINDRETGRSRGFGFVTFSSEQAMRDAIEGMNGKELDGRNITVNEAQSRRSGGGGGGGYGQRGGGGGYGGGGGYGGGGGGGYASREGGYGGGGGYGGGRGGGGGYGGGYGRGGGNSDGNWRN

SEQ ID NO: 26359 - protein, 146 aa, Pisum sativum
MAFCNKLGNLLRQGATQSSHAPVSSMLNYLRHMSSSKLFIGGLSYGVDDQSLKDAFASYGEVVEARVITDRDTGRSRGFGFVNFTSDESATSALSAMDGQDLNGRNIRVSYANDRPSAPRGGGGGYGGGYGDGFSNRGGGGGGGGW

SEQ ID NO: 26360 - protein, 162 aa, Solanum commersonii
MAAEVEYSCFVGGLAWATTDRTLSDAFSTYGEVVDSKIINDRETGRSRGFGFVTFKDEKSMKEAISGMNGSELDGRNITVNEAQARGSGGGGGGGGGFGGGRRREGGGGGYGGGGGYRGGGGGGYGGGRREGGGGGGYGGGRREGGGGGGYGGGGYGGGDRY

SEQ ID NO: 26361 - protein, 545 aa, Caenorhabditis elegans
MSKEMRETWKCERRSISRETRQQSSRLRISRRGYCVKFKFSFLEQNAEICQAAYDQSQPDYSTPEGQQAYWAYYQQQQQQQPGGQPDQDPYAAAAYGGHDQAQQPQNPYAPPPPGADPYGQGSGGQSGGSDPYGQSRGGGRGGFGGSRGGGGYDGGRGGSRGGYDGGRGGYGGDRGGRGGGRGGYDGERRGGSRWDDGNSDRQGGPPGGRGGYQGIEYVNCFIFRTTTSLLPKLKKNGYPTEFIIEIQKQKTLNEYKNTCSYRGPRRDGPPSGGGYGGGGAASGNREFGSDGRVELKETVFVQGISTTANEAYIADVFSTCGDIAKNDRGPRIKIYTDRNTGEPKGECMITFVDASAAQQAITMYNGQPFPGGSSPMSISLAKFRADAGGERGGRGGRGGFGGGRGGPMGGRGGFGGDRGGYGGGGGRGGFDGGRGGGGGFRGGDRGGFRGGDRGGFRGGDRGGFRGGDRGGDRGGFRGGRGVGGGNANMEQRKNDWPCEQCGNSNFAFRRECNQCQAPRPDGGSGGGGGERRGGPPGGDRYRPY

SEQ ID NO: 26362 - protein, 380 aa, Avena fatua
MASVAELKERHAAATASVNSLRERLRQRRQTLLDTDVEKYSKAQGRTAVSFNQTDLVCCRTLQGHSGKVYSLDWTPEKNWIVSASQDGRLIVWNALTSQKTHAIKLHCPWVITCAFAPNGQSVACGGLNSACSIFNLNSQVDRNGNMPVSKLLTGPKGYVLSCQYVPDQETRMITGSGDPTCVLWDVTTGQRISIFGGEFPSGHTADVLSLSINSLNTNMFVSGSCDTTVRLWDLRIASRAVRTYHGHEGDINSVKFFPDGHRFGTGSDDGTCRLFDMRIRHQLQVYSREPDRNDNELPSVTSIAFSISGRLLFAGYSNGDCYAWDTLLAEVVLNLGTLQNSHEGRISCLGLSSDGSALCTGSWDKNLKIWAFSGHRKIV

SEQ ID NO: 26363 - protein, 350 aa, Oryza sativa; identical to SEQ ID NO: 3430

SEQ ID NO: 26364 - protein, 383 aa, Spinacia oleracea
MGLLCSKHQHSTKPDAENAQATGIERRIERETIAEKHIQKLLLLGAGESGKSTIFKQIKLLFQMGFDDAELNSYTPVIHANVYQTIKLLIDGSKELAQNETDSSKYSLSPDNKEIGDKLSEIGGRLDYPQLTKELSEEIEKIWNDPAIQETHARSSELQLPDCANYFMEHLDRLSDVNYIPTKEDVLYARVRTTGVVEIQFSPVGENKKSGEVYRLFDVGGQRNERRKWIHLFEGVTAVIFCAAISDYDQMLYEDENKNRMVETKELFEWVLKQRCFERTSIMLFLNKFDIFEKKVQKVPLSTCEWFKDYQPVSSGQQEIEHTYEFVKKKFEELYYQCTAPDRVDRVFKIYRTTALDQKLVKKTFKLLDETLRRRNLVEAGLL

SEQ ID NO: 26365 - protein, 359 aa, Homo sapiens
MTLESIMACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNAV

SEQ ID NO: 26366 - protein, 375 aa, Caenorhabditis elegans
MGCVGAGADAEGREARKVNKQIEEQLAKDKQVMRATHRLLLLGAGESGKSTIVKQMRILHINGFNEAEKREKITDIRRNVRDAMQVILRAMDEIVPKVSLDDPSTAISRDYILRITNDPEDNYPSEFYDHILTCWKDKGVMACYERSSEYQLIDCAQYFLDKVDVVRQNNYDPSEQDILRCRVMTTGIFETKFEVDKVRFHMFDVGGQRDERRKWIQCFNDVTAIIFVCASSSYNLVLWEDNTQNRLRESLALFKNIWNNRWLKTISVILFLNKQDLLSEKIKAKRYLLESFFPEFEGYNLPNDAVFDNQEDKDVVRAKYFIRGEFLRISTANSDGRHHCYPHFTCAVDTENIRRVFNDCRDIIQRIHLRQYELL

SEQ ID NO: 26367 - protein, 219 aa, Avena fatua
STILKQIKLIHEGGYSRDERVPFKEIIFSNTVQSMRVILEAMESLELPLDDQRAEYHVRPSSCSRHRLRATRAFGVGNAISVLWKDAGVQQCFQRSNQYQLNDSAKYYFDSIDRYLAPDYIPNDQDVLRSRVKTTGIVETTFIIGDLTYRMFDVGGQRSEHKKWIHCFENVTTILFLVAISEYDQLLFEDETVNRMQEALTLFDSICNSRWFVKTSIIL

SEQ ID NO: 26368 - protein, 306 aa, Schizosaccharomyces pombe
KMATSSAAAAASTPVNANTITETKNSTFFFDFMMGGVSAAVSKTAAAPIERVKLLIQNQDEMIRAGRLSHRYKGIGECFKRTAAEEGVISLWRGNTANVLRYFPTQALNFAFKDKFKKMFGYKKERDGYAKWFAGNLASGGAAGAASLLFVYSLDYARTRLANDAKSAKKGGERQFNGLVDVYRKTYRSDGLRGLYRGFGPSVVGIVVYRGLYFGMYDTLKPVVLVGPLEGNFLASFLLGWAVTTGSGVASYPLDTIRRRMMMTSGEAVKYSSSFECGRQILAKEGARSFFKGAGANILRGVAGAG

SEQ ID NO: 26369 - protein, 436 aa, Raphanus sativus
MTCLRKTYVNSYTLSFLLVFFVLILFRPAFSINTLSSTESLTISSNRTLVSRGDVFELGFFRTNSSSSWYLGIWYKKLPDRTYVWVANRDNPLSSSIGTLKISNMNLVLLDHSNKSVWSTNVTRGNERSPVVAELLANGNFVMRNSNNNEACQFLWQSFDYPTDTLLPEMKLGYDLKTGLNRFLTSWRSSDDPASGDYSYELELRKFPEFYIFDTDTQVHRSGPWNGIKFSGIPEDQKLSYMVYNFTQNSEEVAYTFLMTNNSFYSRLRMSTSGYFQRLTWTPSSVVWNLFWSSPVNLQCDVYRVCGPNAYCDVNTSPVCNCIQGFMPFNVHQWDLGDGLGGCIRRTRLSCSGDGFTRMKNMKLPETTMATVDPSIGVKECEKRCLSDCNCTAFANADIRNGGTGCVIWTGRLDDMRNYVADGQDLYVRLAAADLV

SEQ ID NO: 26370 - protein, 225 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLGKFSFLFVS

SEQ ID NO: 26371 - protein, 97 aa, Lycopersicon esculentum
IRSFRKNTLATKKNDDEGRTGSSCLYVKVSMDGAPYLRKVDIKTYSNYAALSSALEKMFSCFSIGQCASDKIPGQEKLSESHLMDLLNGSEYVLTYE

SEQ ID NO: 26372 - protein, 102 aa, Lycopersicon esculentum
VRSFRKNMLSQKGNNNNNNNEEISEKDEKTIAFVKVSMDGAPYLRKVDLKMYKSYQQLSHSLTNMFSSFTMGNYGSQGMIDFMNERKLMDVLNSSDYVPTYE

SEQ ID NO: 26373 - protein, 99 aa, Lycopersicon esculentum
  unsure (1)..(99): unsure at all Xaa locations
VRSFRKNVMTVQKNTTGAGEISGTGTGAAFVKVSVDGAPYLRKVDLKMYKSYQQLSDALGKMFSSFTIGNCGTQGXXDFMNESKLIDLLNGSDYVPTYE

SEQ ID NO: 26374 - protein, 87 aa, Lycopersicon esculentum
VRSFRKNILTSQKLDRENDNILVKVSMDGAPYLRKVDLNMYKSYQELFDALTKMFNSFTIVQGMKDFMHEGRLMDLLNSSDYVPTYE

SEQ ID NO: 26375 - protein, 77 aa, Lycopersicon esculentum
VRANRKNSFPSKKAEAECGMYVKVSMDGAPYLRKIDLKLYKGYPELLKALEKMFKLSIGEYSEREGYKGSEFAPAYE

SEQ ID NO: 26376 - protein, 69 aa, Lycopersicon esculentum
VRSYRKNILEASYVKVSMDGAAYLRKIDLNTYKSYPQLLKALENMFKCSIDVYSETDGYNGCNYIPTYE

SEQ ID NO: 26377 - protein, 79 aa, Lycopersicon esculentum
VRSYRKNHVSKLSESDNNSSGMYLKVSMDGAPYLRKIDLQVYKSYQELLKALQSMFKCTIGVYSEREGYNGSDYAPIYE

SEQ ID NO: 26378 - protein, 100 aa, Lycopersicon esculentum
IRSFRKNTLASASKNNEEVDGKAGSPALFIKVSMDGAPYLRKVDLRTCSAYQELSSALEKMFSCFTIGQYGSHGAPGKDMLSESKLKDLLHGSEYVLTYG

SEQ ID NO: 26379 - protein, 75 aa, Lycopersicon esculentum
VRSYRKNVIEKCKYVKVAVDGAPYLRKVDLEMYDSYQKLLNALENMFTCLTICNSQSESKLMDLTNGVEYVPTYE

SEQ ID NO: 26380 - protein, 209 aa, Petromyzon marinus
MDADGSTTDASQLGITGDYIGGGHYVLQSSDGDAEGSLASGDHDESCGSKDPYREQDIYLPIANVARIMKTSIPSSGKIAKDAKECVQECVSEFISFITSEASERCHQEKTKTINGEDILFAMSTLGFDSYVEPLKQYLQKYRESMKGEKGINATVVTTTDAIPEELTEESFSGPLATSIITADGQQQNVMVYTTAYQQIPGVQPIQFT

SEQ ID NO: 26381 - protein, 346 aa, Ricinus communis
MSKAGALDLASGVGGKIDKNEVLSAVEKYEKYHVYYGGAEEERKANYTDMVNKYYDLVTSFYEFGWGESFHFAHRFKGESLRESIKRHEHFLALQLGLKPEQKVLDVGCGIGGPLREISRFSLTSVTGLNNNEYQITRGKVLNRIAGVDKTCDFVKADFMKMPFPANSFDAVYAIEATCHAPDAYGCYSEIYRVLKPGQFFAAYEWCMTDSFDPNNQEHQKIKAEIEIGDGLPDIRLTGQCIEALKKAGFDVIWSGDLTASSPVPWYLPLDKNQYSLTGFRLTAIGRFFTRNMIKALEFAGLAPKGSQRVQDFLEKAAEGLVEGGRKEIFTPMFFFLAQKPHSENQ

SEQ ID NO: 26382 - protein, 231 aa, Drosophila melanogaster
MANKVLRKVTHCVFDMDGLLLDTERLYTVATEMILEPYGKTYPFEIKEQVMGLQTEPLARFMVEHYELPMSWEEYARQQRANTEILMRNAQLMPGAERLLRHLHANKVPFCLATSSGADMVELKTAQHRELFSLFNHKVCGSSDKEVVNGKPAPDIFLVAAGRFGVPPKPSDCLVVQDSPNGVTAANSAGMQVVMVPDPRLSQEKTSHATQVLASLADFKPEQFGLPAFTD

SEQ ID NO: 26383 - protein, 221 aa, Arabidopsis thaliana
MDGLLLDTEKFYTEVQEKILARYNKTFDWSLKAKMMGRKAIEAARLFVDESGISDSLSAEDFIVERESMLQDLFPTSDLMPGASRLLRHLHGKGIPICIATGTHTRHFDLKTQRHRELFSLMHHVVRGDDPEVKEGKPAPDGFLAASRRFEDGPVDPRKVLVFEDAPSGVQAAKNAGMNVIMVPDSRLDKSYCNVADQVLASLLDFKPEEWGLPSFQDSHN

SEQ ID NO: 26384 - protein, 2549 aa, Homo sapiens [sequence omitted]

SEQ ID NO: 26385 - protein, 328 aa, Nicotiana plumbaginifolia
MAQESLVLRGTMKAHTDWVTAIATPIDNSDMIVTSSRDKSLIVWSLTKDGPQYGVPRRRLTGHGHFVQDVVLSSDGMFALSGSWDGELRLWDLQAGTTARRFVGHTKDVLSVAFSVDNRQIVSASRDKSIKLWNTLGECKYTIQEGDSHSDWVSCVRFSPNTLQPTIVSGSWDRTVKIWNLTNCKLRSTLAGHAGYVNTVAVSPDGSLCASGGKDGTILLWDLAEGKKLYSLDAGSIIHALCFSPNRYWLCAATETSIKIWDLESKSIVVDLKVDLKQESEMATEGTTGSACKNKIMYCTCLSWSADGSTLFSGYTDGLIRVWGIGRY

SEQ ID NO: 26386 - protein, 274 aa, Lycopersicon esculentum
MGRQPCCDKVGLKKGPWTAEEDKKLINFILNNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPITHKPLSTITIDHTNTLEQENQPIEEEKNQDILLAQMDIESSSIDQSTVAKIKSEDDNNNSNNNTMATNCTNNFDSTIVEVNNNGFCIDEVPLIEPHEILVQESTPSTSSSSFSSSSSSNILEDLKFLSSFDEWPLMENNNNNNVGIWMGN

SEQ ID NO: 26387 - protein, 333 aa, Craterostigma plantagineum
MNQQQVKVSKNNKQVNNCEDDDDSSDLRRGPWTVDEDFTLINYIAHHGEGRWNSLARFAGLKRTGKSCRLRWLNYLRPDVRRGNITLEEQLLILELHSRWGNRWSKIAQHLPGRTDNEIKNYWRTRVQKHAKQLKCDVNSKQFKDTMRYLWMPRLVERIQASATTDDGAPPAVASSPSSAMNTACYSAAMAAGDHRRQFMLMPQYYATTTTTHNNSMIAQENSSTVASSESFGSLSSELTAEANYANYHRVINGADHQQIDSSTTSYDWQNCAVGNNGNSDQLGMGFADDRRSNEQWMMMTDDVVDNGGSSDQDNNLWNVDDVWFLQQFSSCF

SEQ ID NO: 26388 - protein, 333 aa, Craterostigma plantagineum
MNQQQVKVSKNNKQVNNCEDDDDSSDLRRGPWTVDEDFTLINYIAHHGEGRWNSLARFAGLKRTGKSCRLRWLNYLRPDVRRGNITLEEQLLILELHSRWGNRWSKIAQHLPGRTDNEIKNYWRTRVQKHAKQLKCDVNSKQFKDTMRYLWMPRLVERIQASATTDDGAPPAVVSSPSSAMNTACYTTAMAAGDHRRQFMLMPQYYATTTTTHNNSMIAQENSSTVASSESFGSLSSELTAEANYANYHRVINGADHQQIDSSTTSYGWQNCAVGNNGNSDQLGMGFADDRRSNEQWMMMTDDVVDNGGSSDQDNNLWNVDDVWFLQQFSSCF

SEQ ID NO: 26389 - protein, 335 aa, Craterostigma plantagineum
MNQQQVVKVSKNKQINSEDDDDSSDLRRGPWTVDEDFTLINYIAHHGEGRWNSLARFAGLKRTGKSCRLRWLNYLRPDVRRGNITLEEQLLILELHSRWGNRWSKIAQHLPGRTDNEIKNYWRTRVQKHAKQLKCDVNSKQFKDTMRYLWMPRLVERIQRAATTDDGAPPLASSASSPSSAMNTACYSTAMAAGDHRRQFMLMPQYYAMTTHSNLMIAQENSSTVASSESFGSLSSELTEANYANYHQVINGADHQQIDSSTTTSYGWQNDFAINTVGNNGNSDQLGMGSVDDRRSNEQWMMMDDVDNGGSSDKDNNLLWNVDDVWFLQQFSSCF

SEQ ID NO: 26390 - protein, 198 aa, Gossypium hirsutum
MAPKKAGVSKRVFNKGSWTAEEDRRLAKYIEIHGAKRWKTIAIKSGLNRCGKSCRLRWLNYLRPNIKRGNISDEEEDLIIRLHKLLGNRWSLIAGRLPGRTDNEIKNYWNSHLSKKMINHDVRTEQTSSSEQIVPHKAWETVQMEEEEVVKGSDEIENSEFSIDVDEFFDFSTEGCFGLDWVNKFLELDDQQDPLAMV

SEQ ID NO: 26391 - protein, 141 aa, Solanum tuberosum
MKGAKSKAKADTKLGVRKKATESKKAKNAAKDPNKPKRPPSAFFVFMEEFRKTYKEKHPNNKSVAVVGKAGGDKWKQLSDEEKAPYQAKAEKRKAEYQKNMDAYNKKLAAGDADDEESDKSKSEVHDDDEDDDGSEQEDDD

SEQ ID NO: 26392 - protein, 141 aa, Canavalia gladiata
MPKVKADAKAADNRLKRKGAGAGRKQSKKAAKDPNKPKRPPSAFFVFMSEFREQYKKEHPTNKSVAVVGKAGGDKWKSLSDAEKAPFVARAEKKKEEYDKSILAYNRKLEGKNPSEEEKSDKSKSEVNDEDEDEEEDQDDE

SEQ ID NO: 26393 - protein, 313 aa, Helianthus annuus
MTCTGMAFFSSNFMLQSSQEDDHHAPTSLSPILPPCSTTTQDFSGAAFLGKRSMSSYSGLNNNNMDGCDQEGNMNGEDELSDDGSQLLAGEKKRRLNMEQVKTLQRNFELGNKLEPERKMQLARALGLQPRQIAIWFQNRRARWKTKQLEKDYDALKRQFEAVKAENDSLQSQNHKLHAEIMALKNREPAELINLNIKETEGSCSNRSENSSEIKLDISRTPATDSPLSSHHQHQHQPIPNLFPSSNIDRPNSNNIVAHQLFHNSSSRPADHQLHCHKLDQSNAIKEECFSTMFVGMDDQSGFWPWLEQPQFN

SEQ ID NO: 26394 - protein, 301 aa, Arabidopsis thaliana
MKRLSSSDSMCGLISTSTDSFGYTTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 26395 - protein, 314 aa, Oryza sativa
EESMEMMVHGRRDEQYGGLGLGLGLGLSLGVAGGAADDEQPPPRRGAAPPPQQQLCGWNGGGLFSSSSSDHRGRSAMMACHDVIEMPFLRGIDVNRAPAAETTTTTARGPSCSEEDEEPGASSPNSTLSSLSGKRGAPSAATAAAAAASDDEDSGGGSRKKLRLSKDQAAVLEDTFKEHNTLNPKQKAALARQLNLKPRQVEVWFQNRRARTKLKQTEVDCELLKRCCETLTDENRRLHRELQELRALKLATAAAAPHHLYGARVPPPTTLTMCPSCERVASAATTTRNNSGAAPARPVPTRPWPPAAAQRSSA

SEQ ID NO: 26396 - protein, 292 aa, Dianthus caryophyllus
MATSTATNHFLKTLAISITTQKPTSIFPPKSLVLEKPTTNNSQFHYKTHHLCCMCCLQTSDFEQESSPNAVIDEEENVEKTEAAVNWEDASEPQPSSGFGSEDGFSEPSEDVKLYVGNLPFDVDSEKLANMFDAAGVVEIAEVIYNRETDRSRGFGFVTMSTVEEADKAVEMFHSYELNGRLLTVNKAAPRGSRPEKAPREFCPLLSESYVGNLPWDVDNDRLEQLSSEHGKVLSARVVSDRETERSRGFGFVTMASETEMNDATLGALDGESLEGRPIRVNVAEERPRRTF

SEQ ID NO: 26397 - protein, 220 aa, Spinacia oleracea
SISSSFVRHVRISSEFEQEEDVMGDDDAGRQPNFSPDLKIFVGNLPFNVDSAELAGLFGAAGTVEMVEVIYDKLTGRSRGFGFVTMSSVEEVEAAAQQFNNYELDGRTLRVTEDSHKDMTLPRVESECDSFGSSNRVHVGNLSWKVDDDALKTLFSETGDVVEAKVIYDRDTGRSRGFGFVTYNSANEVNTAIESLDGVDLNGRSIRVTAAEARQRRGPK

SEQ ID NO: 26398 - protein, 443 aa, Pisum sativum
MRDHKGEVQYFIGVQLDGSQHVEPLHNCIAEDTRKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMRNRNKVHRACTEREILDMLDHPFLPALYASFQTKTHVCLITDYYPGGELFLLLDQQPTKVLKEDSVRFYAAEVVIALEYLHCLGIIYRDLKPENVLIQSNGHVSLTDFDLSCLTSSKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 26399 - protein, 631 aa, Solanum tuberosum
MESLVDGISSLPNVHNSFAAVECNTSLASKISHPPLMKQSENKESSISYPIAMDLGSNTAHTQTGSVTGSKHFEANEDTVNQLAEGCSGEQVLALETESSIKDLHYVSKNSTSNDDLNAAAAKGLPSESGITYCPSPQNSFYSATQYTEAKQSFSNTEVSECASSTVDKSGESGDVSNSCDLVESRKTSFYRGSTGSDVSDESSSSSFNSTTVYKPHKANDTRWDAIQVIRAREGTLGFNHFRLLKRLGCGDIGSVFLAELIGTRCFFAMKVMDKAALESRKKLVRAQTEREILQSLDHPFLPTLYSHFETDKFSCLVMEFCPGGDLHALRQKQPGKFFPEHAARFYVAEVLLALEYLHMLGIIYRDLKPENVLVREDGHIMLSDFDLSLRCAVSPTLVRSSNSSLESKSSSYCVQPACIEPSCVIQPACIQPSCFTPRFLSKTKKEKKSKQKTETYNQVNRPLPELLAEPTSARSMSFVGTHEYLAPEIIKGEGHGSAVDWWTFGIFLYELLFGQTPFKGAGNRATLFNVVGQPLKFPETPSVSFAARDLIRGLLVKEPQHRLAYRRGATEIKQHPFFQNVNWALIRCTSPPDVPKPSSMTYNMPRTPPAGKTPGVDVKPSGNYFEIDFF

SEQ ID NO: 26400 - protein, 424 aa, Homo sapiens
MSDSKCDSQFYSVQVADSTFTVLKRYQQLKPIGSGAQGIVCAAFDTVLGISVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAGVSSNATPSQSSSINDISSMSTEQTLASDTDSSLDASTGPLEGCR

SEQ ID NO: 26401 - protein, 745 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAQFPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAGVSAARPRQHQKSMSGSVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 26402 - protein, 545 aa, Arabidopsis thaliana
MENQEEDEVVLAKVTSEVEDNFEDEGLVSNSTLEKVAAAKKYIENHYNRRMRHIQQRKERRWVLEQKIASLDVSEKEQLELLEDLQRKETEYTRLMRNRLCVDDFDLLSIIGRGAFGEVRLCREKKTGNIYAMKKLKKSEMLSRGQVEHVRAERNLLAEVASDCIVKLYYSFQDPEYLYLIMEYLSGGDVMTLLMREETLTETVARFYIAQSVLAIESIHKHNYVHRDIKPDNLLLDKYGHMKLSDFGLCKPLDCRNISAMNVNEPLNDENINESIDGDENCSIGRRGRRWKSPLEQLQHWQINRRKLAYSTVGTPDYIAPEVLLKKGYGVECDWWSLGAIMYEMLVGYPPFYSDDPVTTCRKIVSWRTHLVFPEGARLTPEARDLICRLLCDSEHRLGSHGAGAEQIKAHTWFKDVEWEKLYEMDAAFKPVVNGELDTQNFMKFDEVECPKPARTGSGPSWKVLQFSGKSYIIISLIRGVLLCTYRSTGPLFLLVSITPQNINFVGYTYRNFDAVRGSRHSLDIKGSVSPPRSSTDSTRSKSCY

SEQ ID NO: 26403 - protein, 443 aa, Arabidopsis thaliana
MLEKKLAAAEVSEEEQNNLLKDLEMKETEYMRRQRHKMGADDFEPLTMIGKGAFGEVRICREKGTGNVYAMKKLKKSEMLRRGQVEHVKAERNLLAEVDSNCIVKLYCSFQDEEYLYLIMEYLPGGDMMTLLMRKDTLTEDEARFYIGETVLAIESIHKHNYIHRDIKPDNLLLDKDGHMKLSDFGLCKPLDCSNLQEKDFTVARNVSGALQSDGRPVATRRTQQEQLLNWQRNRRMLAYSTVGTPDYIAPEVLLKKGYGMECDWWSLGAIMYEMLVGFPPFYSDDPMTTCRKIVNWRNYLKFPDEVRLSPEAKDLICRLLCNVEQRLGTKGADEIKGHPWFRGTEWGKLYQMKAAFIPQVNDELDTQNFEKFEETDKQVPKSAKSGPWRKMLSSKDINFVGYTYKNVEIVNDDQIPGIAELKKKSNKPKRPSIKSLFGKSSV

SEQ ID NO: 26404 - protein, 347 aa, Daucus carota
MFFFSTANPVLDCGSCEKPPPHHKPAPHKPPTVKPPVVKPPIVKPPVVKPPVVKPPVVKPPIVKPPIVKPPGLLPPILPPGILPPGVLPPGVLPPGVLPPLPPGVLPPGILPPGVLPPGVLPPGVVPPIKPPGGLLPPGVLPPGVLPPGVLPPLPPGVLPPGVLPPLPPGVLPPGVLPPGVLPPGIKPPGGLLPPGVLPPGVLPPGILPPGILPPGVLPPGILPPGILPPGVKPPVLPPTTKPPSPGTPCPPGAKTPPSAPETCPLDALKLGACVDVLGGLVHVGLGDPNVNKCCPVLAGLVELEAAVCLCTTIKLSLLNINIALPVALQLLITCGKTPPPGFTCPT

SEQ ID NO: 26405 - protein, 273 aa, Zea mays; identical to SEQ ID NO: 6730

SEQ ID NO: 26406 - protein, 243 aa, Antirrhinum majus
MGRGRVELKRIENKINRQVTFAKRRNGLLKKAYELSVLCDAEVALIIFSNRGKLYEFCSNSGTMLKTLERYQKCNYGAPEANVSTREALELSSQQEYLKLKARYEALQRSQRNLLGEDLGPLNSKELESLERQLDMSLKQIRSTRTQAMLDTLTDLQRKEHALNEANRSLKHRLMEGSQISLQWNPNAHDMGYGRQAAAQPQGDGFFHPLECEPTLQMGFQSEITVGAAGPSVNNYNMTGWLP

SEQ ID NO: 26407 - protein, 242 aa, Antirrhinum majus
MGRGRVELKRIENKINRQVTFAKRRNGLLKKAYELSVLCDAEVALIIFSNRGKLYEFCSSTSMLNTLERYQKCNYGPPETNVSTREALELSSQQEYLKLKARYEALQRSQRNLLGEDLGPLNSKELESLERQLDMSLKQIRSTRTQAMLDTLTDLQRKEHALNEANRSLKHRLMDGSQISLQWNPNAEDHVGYGRQPSQPSADGFYHPLECEPTLHIGFQSDQITVAGAGPSVNNYISGWLP

SEQ ID NO: 26408 - protein, 247 aa, Antirrhinum majus
MGRGRVELKRIENKINRQVTFAKRRNGLLKKAYELSVLCDAEVALIIFSNRGKLYEFCSSSNMLKTIERYQKSSYGSLEVNHQAKDIEASSYKEYLKLKSKYESLQGYQRHLLGDDLGPLNMNDLEHLEHQLETSLKHIRSTRTQVMLDQLSDLQTKEKMMVDANKALERKLEEIYAANHLQQSWGGGGDHSNAYNDHQHAQSQGFFQPLECNSTLQIGFNDPVASSQMTAPTDAQNMHGLVPGWML

SEQ ID NO: 26409 - protein, 255 aa, Zea mays; identical to SEQ ID NO: 5594

SEQ ID NO: 26410 - protein, 247 aa, Pisum sativum
MGRGRVELKRVENKINRQVTFAKRRNGLLKKAYELSVLCDAEVALIVFSNRGKLYEFCSTSSMLKTLERYQKCNYGAPEGNVTSKEALVLELSSQQEYLKLKARYESLQRSQRNLMGEDLGPLSSKDLETLERQLDSSLKQIRSTRTQFMLDQLGDLQRKEHLLCEANRALRQRMEGYQINSLQLNLSAEDMGYGRHHQGHTHGDELFQVQPIECEPTLQIGYHQGDPGSVVTAGPSMNNYMGGWLP

SEQ ID NO: 26411 - protein, 229 aa, Medicago sativa
MARGKIQIKRIENTTNRQVTYSKRRDGLFKKANELTVLCDAKVSIIMFSSTGKLHEYISPSASTKQFFDQYQMTVGIDLWNSHYENMQENLKKLKDVNRNLRKEIRQGMGECLNDLSMEELRLLEDEMDKAAKAIRERKYKVITNQIDTQRKKSNNEREVHNRLLRDLDARAEDPRFEMMDNGGEYESVIGFSNLGPRMFALSLQPTHPNPHNGGASAASDLTTYPLLF

SEQ ID NO: 26412 - protein, 228 aa, Solanum tuberosum
MARGKIQIKKIENQTNRQVTYSKRRNGLFKKANELTVLCDAKVSIVMISSTGKLHEFISPSITTNNLFDLYQKTIGVDIWTSHYEKMQEQLRKLKDVNRNLRKEIRQRMGESLNDLNFEQLEELMENVDNSLKLIRERKYKVIGNQIETYRKKVRNVEEIHRNLLLEFDARQEDPYGGLVEQEGDYNSVLGFPTGGHHILALGLQPNNNHHHHLHSGGGSDITTFALG

SEQ ID NO: 26413 - protein, 209 aa, Oryza sativa; identical to SEQ ID NO: 3679

SEQ ID NO: 26414 - protein, 251 aa, Brassica oleracea
MGRGRVEMKRIENKINRQVTFSKRRAGLLKKAHEISILCDAEVSLIVFSHKGKLFEYSSESCMEKVLEHYERYSYAEKQLKVPDSHVNAQTNWSVEYSRLKAKIELLERNQRHYLGEDLESISIKELQNLEQQLDTSLKHIRSRKNQLMHESLNHLQRKEKEILEENSMLAKQIRERESILRTHQNQSEQQNRSHHVAPQPQPQLNPYMASSPFLNMGGMYQGEYPTAVRRNRLDLTLEPIYNCNLGYFAA

SEQ ID NO: 26415 - protein, 224 aa, Brassica oleracea var. botrytis
MARGKIQIKRIENQTNRQVTYSKRRNGLFKKAHELTVLCDARVSIIMFSSSNKLHEFISPNTTTKEILDLYQTVSDVDVWSAHYERMQETKRKLLETNRNLRTQIKQRLGECLDEFDIQELLSLEEEMENTFKLVRERKFKSLGNQIETTKKKNKSQQDIQKNLIHELELRAEDPHYGLVDNGGDYDSVLGYQLRFHQNHHHHYPNHALHEASASDIITFHLLE

SEQ ID NO: 26416 - protein, 224 aa, Brassica oleracea var. botrytis
MARGKIQIKRIENQTTGQVTYSKRRNGLFKKAHELTVLCDARVSIIMFSSSNKLHEFISPNTTTKEILDLYQTVSDVDVWNAHYERMQETKRKLLETNRNLRTQIKQRLGECLDEFDIQELCSLEEEMENTFKLVRERKFKSLGNQIETTKKKTRASKTYKKNLIHELELRAEDPHYGLVDNGGDYDSVLGYQLRFHQNHHHHYPNHALHEASASDIITFHLLE

SEQ ID NO: 26417 - protein, 248 aa, Oryza sativa; identical to SEQ ID NO: 3410

SEQ ID NO: 26418 - protein, 231 aa, Sorghum bicolor
MGRGRVELKRIENKINRQVTFAKRRNGLLKKAYELSVLCDAEVALIIFSNRGKLYEFCSGQSITKTLERYEKHMRPDTAVQNKENELVQSSRNEYLKLKARVDNLQRTQRNLLGEDLGSLGIKELEQLEKQLDSSLRHIRSTRTQHMLDQLTDLQRREQMLCEANKCLRRKLEETSNQVHSKCGARCQLTRLRAATPPHSRPHHILAMDCSFIPWKLQQSQPCRSGSLLNI

SEQ ID NO: 26419 - protein, 234 aa, Solanum tuberosum
MAREKIKIKKIDNITARQVTFSKRRRGLFKKAEELSVLCDADVALIIFSSTGKLFDFASTSMKDILGKYKLQSASLEKVDEPSLDLQLENSLNMRLSKQVADKTRELRQMRGEELEGLSLEELQQIEKRLEAGFNRVLEIKGTRIMDEITNLQRKGAELMEENKQLKHKMEIMKGKLPLLTDMVMEEGQSSESIITTNNPDQDDSSNASLKLGGTTAVEDDCSITSLKLGLPFS

SEQ ID NO: 26420 - protein, 228 aa, Solanum tuberosum
MARGKIQIKKIENQTNRQVTYSKRRNGLFKKANELTVLCDAKVSIVMISSTGKLHEFISPSITTKQLFDLYQKTIGVDIWTSHYEKMQEQLRKLKDVNRNLRKEIRQRMGESLNDLNFEQLEELMENVDNSLKLIRERKYKVIGNQIETYRKKVRNVEEIHRNLLLEFDARQEDPYGGLVEQEGDYNSVLGFPTGGHHILALGLQPNNNHHHHLHSGGGSDITTFALG

SEQ ID NO: 26421 - protein, 221 aa, Solanum tuberosum
MVRQKIQIKKIDNLTARQVTFSKRRRGLFKKAQELSTLCDADIGLIVFSATGKLFEYSSSSMMQLIEKHKMQSERDSMDNPEQLHSSNLLSEKKTHAMLSRDFVEKNRELRQLHGEELQGLGLDDLMKLEKLVEGGISRVLRIKGDKFMKEISSLKKKEAQLQEENSQLKQQSQARLNEEGQNVIEQGHSADSITNNRSLVNSHQDYNDSDTSLKLCLAFP

SEQ ID NO: 26422 - protein, 213 aa, Sinapis alba
MVRGKTQMKRIENATSRQVTFSKRRNGLLKKAFELSVLCDAEVSLIIFSPKGKLYEFASSNMQDTVDRYLRHTKDRVSSKPVSEENMQHFKHEAANMMKKIEQLEASKRKLLGEGIGSCSIEELQQIEQQLEKSVKCVRARKTQVFKEQIEQLKQKEKALAAENEKLAEKWGSHEIEVWSNKKQESGRGDEESSPSSEVETQLFIGLPCSSRK

SEQ ID NO: 26423 - protein, 221 aa, Pinus radiata
MVRGKTQMKRIENDTSRQVTFSKRRNGLLKKAYELSVLCDAEVGLIIFSPRGKLYEFASPSMEEILEKYKKRSKENGMAQTTKEQDTQYSKHSKQKLANMEEQIRILESTQRKMLGEGLESCSMAELNKLESQAERGLSHIRARKTEILVDQIECLKRKERLLSEENALLSRKWVDRQSVDGSGSTSSSIGLGSIEQIEVETQLVIRPPNAQDHCSVNSGH

SEQ ID NO: 26424 - protein, 223 aa, Pinus radiata
MVRGKTQMKRIENATSRQVTLSKRRNGLLKKAYELSVLCDAEVGLIVFSPSGKLYEFASTSMQKLLEKYEICSQECGTSESNKKQDPQCLKQEIENMEKRVRILQSTQRKMLGEGLALCSIKELNQLEGQVERGLNHVRATKTKVLLDEIEKLKQKEHVFREEKALLHKKSVNLRGANGCTIPSIGLTSIERVEVQTQLVMRPPHATEMDDNFMDVDNVPLSG

SEQ ID NO: 26425 - protein, 214 aa, Pinus radiata
MARGKTQMRKIESATSRQVTFSKRRNGLLKKAYEMSVLCDAQLGLIVFSPRGKVYEFSSTCMQKMLARYENFSEGSKATSTAKEQDVQGLKRQIANMEERIEILESMHRKMLGDELASCALKDLNELESQVERGLRNVRARKTEILVTEIEQLQRKEWILSEENAFLGKKFVHPHSVSKTPGSESGSIQNSEVETQLVMRPPCTNAHFLINSSH

SEQ ID NO: 26426 - protein, 199 aa, Pinus radiata
  unsure (1)..(199): unsure at all Xaa locations
MARGKTQMRKIESATSRQVTFSKRRNGLMKKAYELSVLCDAQLGLIVFSPRGKVYEFSSTCMQKMLARYEKCSEGSDTSTSKEQDVQCLKRESANMEERIEILESMQRKMLGEELASCALKDLNQLESQVERXLRNVRARKERILSEENAFLSKKFVDPQSFSTTPGSESGSIQNSEVETQLVMRPPCTNAHFLINSSH

SEQ ID NO: 26427 - protein, 245 aa, Pinus radiata
MGRGKVELKRIENKINRQVTFAKRRNGLLKKAYELSVLCDAEVALIIFSNRGKLYEFCSSSSMMKTIEKYQKCSYGSLETNCSINEMQNSYQDYLELKARVEVLQRSQRNLLGEELGPLNSKELEQLEHQLENSLKQIRSAKTQFMFDQLAHLQHKEQMLVEANRELRKKLEESNTRIPLRLGWEAEDHNNISYRRLPTQSQGLIFQPLGGYPNMQIGYNPAGSNELNVSPADQHPNGFIPGWML

SEQ ID NO: 26428 - protein, 265 aa, Brassica napus
MDRGKIEIKRIENANSRQVTFSKRRAGLLKKAHELSVLCDSEVAVIVFSKSGKLFEFSSTGMKRTVLRYENYQRSSDAPLIKYKPENQEEDCTEVDFLKNEISKLQEKHLQMQGKGLNALCLKELQHLEQQLNVSLISVRERKELLLTKQIEESRIREQRAELENETLRRQVQELRNFLPSINQNYVPSYITCFAIDPKNSPVNNSGLDDTNYSLQKTNSDTTLQLGLPGEAQARRRSEANRESPSSDSVTTSTTKATPQRINLV

SEQ ID NO: 26429 - protein, 254 aa, Cucumis sativus
MSCYEEEDEESGVVGLRRSSSSSRTGRGKIEIKRIENTTNRQVTFCKRRNGLLKKAYELSVLCDAEVALIVFSSRGRLYEYANNSVRATISRYKKAYSDPSTAMTVSEANTQFYQQESAKLRAQIGNLQNLNRHLLGESISSLSVKDLKSLEVKLEKGISRIRSRKNELLFSEIEYMQKREIELHTNNQLIRAKIAETERSQQNTNASNNNGIATRRGEEGSMGTNLEDNNHHQYDSTNYFDPHHNHPISLQLV

SEQ ID NO: 26430 - protein, 513 aa, Picea abies
MAGGMAVSRPKQGRAELYEGHITAYVILACIVAATGGSLFGYDLGVSGGVTSMDDFLKKFFRHVYERKQHHLRETDYCKYDNQLLTLFTSSLYLSGLVATFGASYITRSKGRRVSIIIGGLSFLLGAILNAAAKNLGMLIVGRILLGAGVGFSNQSVPLYLSEMAPAKVRGGTNNLFQLKTCLGIFVTNVINYFTNKLHPWGWRLSLGLAVIPALLMSIGGYFLPETPNSLVEQGRLQEGRQILEKIRGTKNVQAEFDDLVEASDVARAVKHPFRNLLQRRNRPQLVMGTCIPAFQQLTGNNSFLFYAPVIFQSLGMGNDASLYSAIMTGAVITFGALVSMFTVDRVGRRFLFMEGGTQMIVCHVIISILLKSNFGKGEKIPTGYGVGIVLLICIFYLLAYGWLWGPLSWLVCSEIFPMESLVVCVNLFFTAVIAQSFLALLCHLKYGIFLLFGGLVFIMSVVIYFFLPETKNVPIEEMRFQWAKHWYWKRFMDEYMDNDDENEKGNMTKAAA

SEQ ID NO: 26431 - protein, 516 aa, Vicia faba
MPAAGIPIGAGNKEYPGNLTPFVTITCVVAAMGGLIFGYDIGISGGVTSMNPFLEKFFPAVYRKKNAQHSKNQYCQYDSETLTLFTSSLYLAALLSSVVASTITRRFGRKLSMLFGGLLFLVGALINGLAQNVAMLIVGRILLGFGIGFANQSVPLYLSEMAPYKYRGALNIGFQLSITIGILVANILNYFFAKIKGGWGWRLSLGGAMVPALIITIGSLILPDTPNSMIERGDRDGAKAQLKRIRGVEDVDEEFNDLVAASETSMQVENPWRNLLQRKYRPQLTMAVLIPFFQQFTGINVIMFYAPVLFNSIGFKDDASLMSAVITGVVNVVATCVSIYGVDKWGRRALFLEGGVQMLICQVAVAVSIAAKFGTSGEPGDLPKWYAIVVVLFICIYVAGFAWSWGPLGWLVPSEIFPLEIRSAAQSVNVSVNMLFTFLVAQIFLTMLCHMKFGLFLFFAFFVVVMTIYIYTMLPETKGIPIEEMDRVWKSHPYWSRFVEHDDNGVEMAKGGVKNV

SEQ ID NO: 26432 - protein, 703 aa, Arabidopsis thaliana
MASSAFAFPSYIITKGGLSTDSYLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGNTINHSFGMAVGRDLKGKNNNVVAVIGDGAMTAGQAYEAMNNAGYLDSDMIVILNDNKQVSLPTATLDGPSPPVGALSSALSRLQSNPALRELREVAKASLLHFFSRMGMTKQIGGPMHQLAAKVDEYARGMISGTGSSLFEELGLYYIGPVDGHNIDDLVAILKEVKSTRTTGPVLIHVVTEKGRGYPYAERADDKYHGKTSVVKFDPATGRQFKTTNKTQSYTTYFAEALVAEAEVDKDVVAIHAAMGGGTGLNLFQRRFPTRCFDVGIAEQHAVVHDVDLQKLPVRFAMDRAGLVGADGPTHCGAFDVTFMACLPNMIVMAPSDEADLFNMVATAVAIDDRPSCFRYPRGNGIGVALPPGNKGVPIEKISLGVFQIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 26433 - protein, 735 aa, Chlamydomonas reinhardtii
MLRGAVSHGPAVADRAAAGPARCAAPVARGVRSAAPTRQRRAEASVNAPRAGPAGSYSGEWDKLSVEEIDEWRDVGPKTPLLDTVNYPVHLKNFNNEQLKQLCKELRSDIVHTVSRTGGHLSSSLGVVELTVAMHYVFNTPEDKIIWDVGHQAYGHKILTGRRKGMATIRQTNGLSGFTKRDESEYDPFGAGHSSTSISAALGMAVGRDVKGKKNSVIAVIGDGAITGGMAYEAMNHAGFLDKNMIVILNDNQQVSLPTQYNNKNQDPVGALSSALARLQANRPLRELREIAKGVTKQLPDVVQKATAKIDEYARGMISGTGSTLFEELGLYYIGPVDGHNLDDLIAVLSEVRSAETVGPVLVHVVTEKGRGYLPAETAQDKMHGVVKFDPRTGKQVQAKTKAMSYTNYFADALTAEAERDSRIVAVHAAMAGGTGLYRFEKKFPDRTFDVGIAEQHAVTFAAGLACEGLVPFCTIYSTFMQRGYDQIVHDVSLQKLPVRFAMDRAGLVGADGSTHCGAFDVTFMASLPHMITMAPSNEAELINMVATCAAIDDAPSCFRFPRGNGLGLDLAAYGISKDLKGVPLEVGKGVVRRQGKDVCLVAYGSSVNEALAAADMLERDGVSTTVIDARFCKPLDTKLIRSAAKEHPVMITIEEGSVGGFAAHVMQFLALEGLLDGGLKFRPMTLPDRYIDHGDYRDQLAMAGLTSQHIASTALTTLGRAKDAAKFSLSALQA

SEQ ID NO: 26434 - protein, 208 aa, Homo sapiens
MDQWGVYFNPVLVSFCQSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRGKRYLKGTSVGLF

SEQ ID NO: 26435 - protein, 785 aa, Caenorhabditis elegans
MGASHLHDDPRPGSPVDHQPTTWGGIIKKWPKQTFLIVGNELCERFSFYGMRAVLTLYFFNILNFSQSFSTVLFHAFTVICYSSPLLGSILADGYIGKFWTIFFISIFYACGQILLAFSSIAPSGSSHHPLLDLLGLLIVGLGTGGIKPCVSAFGGDQFPAHYTRMISLFFSMFYFSINAGSLISMWLTPYFRSMSCFGHDSCYPLAFGIPAILMIVATLVFMAGSFWYKKVPPKENIIFKVIGTITTALRKKASSSSTHQRSHWLEYSLDGHDCALSTECKNLHGNCAQRRYIEDIKRLFRVIVMMIPVPMFWALYDQQGSTWVLQAVGMDAKVFGFEILPDQMGVLNAFLILFFIPIFQSIVYPTIEKLGFQMTMLRKMAGGGILTAVSFFVCGIVQLFVNPTLPYIPMANEAHLTIINTIPSCDFNVLIDSREPFDLLRKSGIAPDDSVRKPISFTGDDFFQPNITFDNLAPNCPKFTAKPMLAPATSYVLTLSPNGWAYNAVRPEKPKSGKGELSMGLNLIVPCDKIPSNVTWEQCNGTEGYSGAIALCKVESDVITDNNNVCDPTAKGKFYVLSNANPLDVHDFSKKSTVTAFGRTYSPIEMKPGTYRLFYTDDSRTHFTPLNLPPVQQDHMGGQYLITVSTRSKNDSEVLATTESLVSYNRVSILWQIPQYVILTAGEVLFSITGLEFAYTEASPQLKSVVQALWLFTTAIGDLIVVVIFMLNIFSDVAVQMFVFGGIMLFVIFVFILLAVFYYEYADYSNESEVLTEKMIVDDDHTRI

SEQ ID NO: 26436 - protein, 743 aa, Drosophila melanogaster
MASEITNGKNGQNGKNGQKEESDSQIAPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGTGGIKPCVSAFGGDQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGLLLAALGFFLSAGLEMKMEQAAYRATPIEPDMTHLRIYNGMPCRYEISSAVVQTPRVIEPLNVWEDLSLQMTESKEYTFNAQPVSGECPSITDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVAPSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 26437 - protein, 734 aa, Drosophila melanogaster
MAFVSNAIVGPENCKSVTPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGTGGIKPCVSAFGGDQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGLLLAALGFFLSAGLEMKMEQAAYRATPIEPDMTHLRIYNGMPCRYEISSAVVQTPRVIEPLNVWEDLSLQMTESKEYTFNAQPVSGECPSITDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVAPSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 26438 - protein, 78 aa, Zea mays
AVATALIQVAYMGLVGSFPFNSFLSGVLSCIGTAVLAVCLRIQVNKDNKNSGPSPRRAFADFVLCNLVLHLVIMNFLG

SEQ ID NO: 26439 - protein, 530 aa, Glycine max; identical to SEQ ID NO: 2721

SEQ ID NO: 26440 - protein, 530 aa, Nicotiana plumbaginifolia
MADIEGEPGSSMHGVTGREPVLAFSVASPMVPTDTTAKFSVPVDTEHKAKVFKFYSFSKPHGLTFQLSWISFFTCFVSTFAAAPLVPLIRDNLNLTKMDVGNAGVASVSGSILSRLVMGAVCDMLGPRYGCAFLIMLSAPTVFCMSFVSSAGGYVAVRFMIGFSLATFVSCQYWMSTMFNSQIIGLVNGTAAGWGNMGGGATQLIMPILYDIIRKAGATPFTAWRIAFFIPGWLHVVMGILVLTLGQDLPDGNRGDLQKKGGVSKDKFTNILWYAATNYRTWIFVLLYGYSMGVELSTDNVIAEYFFDRFDLKLHTAGIIAATFGMANLLARPFGGFSSDFAAKRFGMRGRLWVLWILQTLGGVFCVLLGRSNSLPIAVTFMILFSVGAQAACGATFGIIPFISRRSLGIISGMTGAGGNFGSGLTQLLFFTSSKYSTATGLTYMGMMIIGCTLPVTLCHFPQWGSMFFPPTKDPVKGSEEHYYAAEYTEAERQKGMHQNSLKFAENCRSERGKRVGSAPTPPNLTPNRV

SEQ ID NO: 26441 - protein, 334 aa, Homo sapiens [sequence omitted]

SEQ ID NO: 26442 - protein, 261 aa, Thermoanaerobacterium thermosulfurigenes
MPKLLTKEEEKILFERLRNGDESAKDVLVECNIRLVDKVAAGFLKSGVEFDDLVQEGLIGLLTAIDKFDHTKGYKFSTYATWYIQQSMRRYIGNYGKIIRLPIHINEKINRILKARYLIEQKKGSLATTEEISRLTGYTEEEIEGYLSYATDVISLNQYVNDERVDAELINFIQDDTIDVEEMAIEKEIKKEIRKILDSLPERERMILKMRFGFGCNLKTLTEIGNIFGLTRERIRQIQNNTIKELRHNRKVKDRLREIMR

SEQ ID NO: 26443 - protein, 246 aa, Myxococcus xanthus
MVTANLRFVVKVAYEYRSYGIKMSDLIQEGNIGLMKAVQKFDPDKGIRLISYAVWWIRAYIQNYILKSWSLVKLGTTQAHGKLFFSLARTRRELEKFGSGDAAVNVDDIARRLHVKPGEVREMEQRMGGRDLSLDAPMGEDGGNSHVDFVVSAAAPQDDEFADKEEAGLINARVRTALMRLDPRERFIIEQRVMNERPMTLKELGEHFGFSRERARQLEIRAKDKLKSELAALMAEVDPEAVAAQQ

SEQ ID NO: 26444 - protein, 303 aa, Xenopus laevis
MSSTGDEIIRIAKKMERMVQKKNTAGALDLLKELKSLPMTLELLQSTRIGMSVNAIRKQSGEEDVTSLAKSLIKSWKKLLDGPSADLEEKKKDQPAPAQNSPEAREESSSSTNFGVLKEECPAPSDDFITSFPRAPSTSDSVRIKCRELLAVALKTGDDHVAIGADVDELGAQIEEAVFQEFKNTDAKYKNRIRSRIANLKDAKNPNLRRNVLCGNIAPDLFARMSAEEMASDELKEMRKNLTKEAIREHQMARTGGTETDLFTCGKCKKKNCTYTQVQTRSADEPMTTFVFCNNCGNRWKFC

SEQ ID NO: 26445 - protein, 303 aa, Xenopus laevis
MSSTGDEIIRIAKKMDRMVQKKNTVGALDLLKELKNLPMTLELLQSTRIGMSVNAIRKQSGEEDVTSLAKALIKSWKKLLDGPSADMEEKKKDQPAPAQNSPEPKEENSSSTNFAAQKDEFPAPSDGFITSFPKAPITSDSVRIKCRELLAAALKTGDDHIAIGANVDELGAQIEDAVFQEFKNTEAKYKNRIRSRIANLKDAKNPNLRRNVLCGNIAPDLFARMTAEEMASDELKEMRKNLTKEAIREHQMAKTGGTETDLFSCGKCKKKNCTYTQVQTRSADEPMTTFVFCNECGNRWKFC

SEQ ID NO: 26446 - protein, 313 aa, Drosophila melanogaster
MSVEEEVFRIQKKMSKMASDGTGQDQALDLLKALQTLNINLDILTKTRIGMTVNELRKSSKDDEVIALAKTLIKNWKRFLASPAPTTPNNSSAKEGSSNNSSASKSTSAAKSSSSISGKDKSSSSSSSKDKEKKGSTSSSQTSFPSGGMTDGVRIKCREMLATALKIGEVPEGCGEPEEMAAELEDAIYSEFNNTDMKYKNRIRSRVANLKDPKNPGLRGNFMCGAVTAKQLAKMTPEEMASDEMKKLREKFVKEAINDAQLATVQGTKTDLLKCAKCKKRNCTYNQLQTRSADEPMTTFVMCNECGNRWKFC

SEQ ID NO: 26447 - protein, 568 aa, Mus musculus
MPGTDLLKLKDFEPYLEILESYSTKAKNYVNGYCTKYEPWQLIAWSVLCTLLIVWVYELIFQPESLWSRFKKKLFKLIRKMPFIGRKIEQQVSKAKKDLVKNMPFLKVDKDYVKTLPAQGMGTAEVLERLKEYSSMDGSWQEGKASGAVYNGEPKLTELLVQAYGEFTWSNPLHPDIFPGLRKLEAEIVRMTCSLFNGGPDSCGCVTSGGTESILMACKAYRDLALEKGIKTPEIVAPESAHAAFDKAAHYFGMKIVRVALKKNMEVDVQAMKRAISRNTAMLVCSTPQFPHGVMDPVPEVAKLTVRYKIPLHVDACLGGFLIVFMEKAGYPLEKPFDFRVKGVTSISADTHKYGYAPKGSSVVMYSNEKYRTYQFFVGADWQGGVYASPSIAGSRPGGIIAACWAALMHFGENGYVEATKQIIKTARFLKSELENIKNIFIFGDPQLSVIALGSNDFDIYRLSNMMSAKGWNFNYLQFPRSIHFCITLVHTRKRVAIQFLKDIRESVTQIMKNPKAKTTGMGAIYGMAQATIDRKLVAEISSVFLDCLYTTDPVTQGNQMNGSPKPR

SEQ ID NO: 26448 - protein, 459 aa, Arabidopsis thaliana
MLKIKRVPTVVSNYQKDDGAEDPVGCGRNCLGACCLNGTFWKPESSFLIMLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVKTLVQRACPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAIGCSNQEEDLEGTIVHQQNSSGNVNQKSNRTHGGPITNGTAAECLVLQ

SEQ ID NO: 26449 - protein, 361 aa, Homo sapiens
MENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 26450 - protein, 347 aa, Homo sapiens
MVGVAEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 26451 - protein, 343 aa, Homo sapiens
MEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 26452 - protein, 111 aa, Drosophila melanogaster
MSSSEEVSWVTWFCGLRGNEFFCEVDEDYIQDKFNLTGLNEQVPNYRQALDMILDLEPEDELEDNPLESDMTEQAAEMLYGLIHARYILTNRGIAQMIEKYQTGDFGHCPR

SEQ ID NO: 26453 - protein, 62 aa, Drosophila melanogaster
MSSSEEVSWVTWFCGLRGNEFFCEVDEDYIQDKFNLTGLNEQVPNYRQALDMILDLEPEDEL

SEQ ID NO: 26454 - protein, 100 aa, Drosophila melanogaster
MSSSEEVSWVTWFCGLRGNEFFCEVDEDYIQDKFNLTGLNEQVPNYRQALDMILDLEPEDELEDNPLQSDMTEQAAEMLYGLIHARYILTNRGIAQMIEK

SEQ ID NO: 26455 - protein, 740 aa, Caenorhabditis elegans
MKRRRGAPLIEDVEKKLQGVIGKVGENTGSSIECNLDKLTAFLHDDLEKYRASIIDIIAGCAIYLPNRVTVYTTLVGLLNSKNFNFGGDVVEKLISEQQDLLSKQKYQEAQNLAIFLCDLGNSGVLTAQSIGEYLESFIAAAFEENMPQVRNDYYIQTVLRCLPWIGKELTEKAPEQMENIGEAIGKYLELRNKNHVALLQVWREGSTDQKQEDYLESLSAQIEALRNADWVENHIPRHYSGFETTLQDALQHNLPSFQSPEHTSDMIYPYPLVVFRLFQDADCSAFSSKPLPGDSSIDRFLFEGEIAWIIEKNQFNRKACARELLAFAEENPSVPIGFLIFETIFGQMLRLPHAPYPAIFHCSLVLELLKLKPDDYPQILVQTVECIYRRADSMQPVCIDRMVDWFSFHLSNFQYRYTWTDWKDCLNKDAFSGSQIFVREVIEKCRRFGSYEKIIAALPQDFVKIHPCSPEVRYLIDEEDTALVQRAETFTQMFQERQPAEAFLNELKSNDENDELPYNINEFGLFVMVMLKMASKTYSHNFSALFRYQTTLKTVCDASELYQEKLLETLYSCWKTNQQMLMILTDKLLKMQVIDCSAVVGWLFDEKMWQEHDRQWLFEVLNQALEKLTRQINVVEKDIKELTEKTENKIKEEDDEESDIKMDEDETKEEKFKQDLEDLENNKEKLERMVTFQKGLFNDFLIHAETLLKHSSNIADEVFSEGTDPSIIECFNQFQSLRL

SEQ ID NO: 26456 - protein, 677 aa, Xanthomonas campestris
MATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKEGLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVLAAKLLDNPGRSGSEHPAVGDAATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 26457 - protein, 377 aa, Zymomonas mobilis
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVSHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDLAEDDFEFWKILTEKLGDKVQLVGDDLFVTNVKRLSDGIERGIANSLLVKFNQIGSLSETLAAVNMANDASYTPVMSHRSGGNRRHHDC

SEQ ID NO: 26458 - protein, 462 aa, Zymomonas mobilis
MAIELKMPALSPTMEEGTLTRWLVKEGDSIKAGEILAEIETDKAIMEFEAVDEGVITKILIPEGSENVKVGTAIAYLGTDANDVTLDGASAETKAEESAPVASPAKTEAAAVEEAATPSLGKVINSAPEIPEGTEFFQQTLREALRDAMAEEMRRDDRVFVMGEEVAEYQGAYKVTQGLLQEFGARRVVDTPISEYGFSGIGVGAAMEGLRPVIEFMTMNFSMQAIDHIINLRPKRIICPAAKCRCPIVFRGPNGAAPPVGEQHTQNFGPWYAAVPGLVVLAPYDAIDAKGLLKAAIRSDDPVVFLECELLYGKTFDVPKMDDFVLPIGKARIIREGKDVTIVSYSIGVSFALTAAEALAKEGIDAEVIDLRTLRPLDKETILQSLAKTNRIVTVEDGWPVCSISSEIAAIAMEEGFDNLDAPVLRVTNADTPTPYAENLEKKGLVNPEAIIEAVRKVCYRK

SEQ ID NO: 26459 - protein, 1146 aa, Vibrio cholerae
MPYWGGTGQEPIGIEHDFASGIAKELGINIEYKGFDTIEALLNAVSTGKADMAIGFGQTLAREGKFLFSKPLYENVRVIWLRDKAMEEKPFASLKWVCIQGTSYCEILKDRGYPNIIMARNYSSSVEMIRQGIADATVTNYVSLNHYLSQKRLALGKVIFDPDLGVQTNRILINNNEPLLLSAINKVIDADKQGLTENKLNSADVYFLNDQANLNILRNENVNPVVRYTIQDDLFPMSYWDEKEKKYKGYVHDLLERISTKSILKFEFVPAYGRDVEDMLRHGKVDLIPSFNMTYVDDRYFIHTGRYTDIQFGYIETTRPYTTPITGILDRTGKFNAYIAVQKNLSDVKVYRSMYDLEQALEKGDITHGLLNKVLINQMLLDGHQDAFKLSPLTEGQDLRADMTMLVRKDARGLQNMLQKVLATFSQQEIDEIKGAYDRVTVYFGYDKQKVLIYALIILCALLSIGLILTLSLSRLRGKLRSSEQVAKLSTEQLRWLTELLDAIPSMIFISDAKGEVVLTNAAYRKIYYTCCEKGCVQPQPECSFLALPDQHEAEFSIIIQAPKSNCSIGEHYFHVTRRAISHPINQRKYYLTLFNDITELKETEQALRQSNEQALQAVEARNHFLAVVSHELRTPIAAMLGLMEILASRLKSSESQLLLTNAISSAERLKLHVNDILDFSKIEAQQLQLDIGLYNLADELGPLLRGFEASAQLKEIEFDVIWSPNSLLLANFDALRFNQIVTNLLSNAIKFTDQGRVVFKIDVAPEMLTIAVEDTGCGMTQTQIESLFVPFAQADSTITRRFGGTGLGMSIVANLIELMNGKIEVKSEFEQGTQIQVNLPLVTQTCDEFRGQVVAMSYRSPYMLWAKALGMRVEENEEWVEQSGHNIYPDLLLNRLREVSNLTQAQTEPAHSRLLQGHVLVADDDAINRLLIKKQLSELGLSATLVSDGLQAFEKLSQHPEQYDLLITDCHMPHLDGFALTRKVKQEISLFKGAVVGCTAEDSRLAAEQALQAGMDKVIYKPYTLANLRKVLSRYLTTQWVALPEQSWLDAYQEEEREEMAMVVAESLAQDIALLNQPDCDVKALAHRIKGAAGSLQLQRLADLAKTVEKQNDPQQLVADKQQLINAMHEVVEQAQQWLHQYQSE

SEQ ID NO: 26460 - protein, 296 aa, Rhodobacter capsulatus
MGETKGGWKLWAVLALPPLFWAGNFIVARASRGEWPPVALSFGRWSIALIALLPFAWPWLRRDWPLYRRYFGRILLLTLPGVAAFNSLVYWGLQTSTATNGMLLNSTIPLLIMALGALFWGQRLGLWAILGLIVSTLGVAVVILQGSWERAAALDFARGDLIIFAAMVAWALYTMGLKTFPAEVNRIGLLAVQIALALPILAPFLVWEISSGRVPVWTPASIGALVYIGIVPSVLAYLFYTKAVEMAGPARAGQFIHLLPVYGAILSAAFLHEPLHLYHAAGFGLILGGIVLAGRR

SEQ ID NO: 26461 - protein, 521 aa, Chlorobium vibrioforme
MSRAHCHSVLTFVNWLIHFCRKYFNKPPMDKILYDALTFDDVLLVPAYSNVLPKETVVKSRVTRNIEVNLPLVSAAMDTVTEAELAIALARAGGIGIIHKNLSIDVQARHVAKVKRFESGIIRNPITLFEDATIQEAIDLMLRHSISGIPVVERPTPEGCLLLKGIVTNRDLRMTTSSNEKITTIITTDLITAQEDIDLLAAEEILMQNKIEKLLVIDEEGYLKGLITFKDIQKRKQCPDACKDMHGRLRVGAAVGIRSNTITRVDALVEAGVDVVAVDTAHGHSQAVLDMVATIKEKYPELEVIAGNVATPEAVRDLVKAGADAVKVGIGPGSICTTRVVAGVGMPQLTAIMNCAKEAAKTDTPIIADGGIKYSGDISKALAAGADTVMMGSIFAGTDESPGETILYEGRRFKAYRGMGSLGAMSEPEGSSDRYFQDASAETKKYVPEGIEGRIPQRPLDEVVYQLIGGLKSSMGYCGVKNIEELKKNTRFVRITSAGLRESHPHDVMITREAPNYSTSH

SEQ ID NO: 26462 - protein, 1202 aa, Spirulina platensis
MSSPNRKLKPTILVVDDEPDNLDLLYRTFHREFKVLKAESGPAALKILEEVGEVAVIISDQRMPYMSGTEFLSLTATQYPDSIRIILTGYTDVEDLVEAINSGKVFKYVTKPWKSDELKAIVQQGLETHNVLKSRTEELRLAQKQESLLYEVTSTIRACPNSQEMLQRIVETVGKMFEVSYCLLRSFGVGSDLIGLGAGVSPTKQDITATQGKEWFAYLAEGQNHQNSTTDNISVINNNDLELRSLVWETTEVMILSEGLGNDISDHDGPEWQQRRDVYQRADIRSSLIVPLYYRQELLAVLALHHTGSPRNWHEHEVQLAAGVADQAALALSQVRAYEQVRELARREALVNTITNAIRSSLDPQKIFAAITEQLGEALEVDGCALSLWSPGDEYMQCVGLYNAAIKETVVETRPAALSEPDTSTTTNLPLLGVETNQSIESDQSDDLPQSAAPISGNPVLQELIRTRAPVAIADIEQRPDSMVMLPLRSPSKALLVVPLLLDGDIIGSISLRQNHQVRHWQPSEIDMVLLVAAQAALAVQQARLYQKTRQQAERLLEADRLKTEFFQNVSHEFRTPLTLMIGPLETVVNQQQDLSLDQAKIALRNSRRLLRLVNQLLDLQRFDAGRMQPSFRPCDLVEFCQQTVESFKSYCDRKQINLVTNLQSCPQLYLDLERFDKVLYNLLSNAMKFTPTDGTITVSLQPEGNYCRLMVKDTGIGIKQEQLPHLFERFRQAEGSANRSFEGSGLGLALVKELVELHHGRITVESEYGQGTTFTVWLQMGNLHLPPSPLLDVPAEFDARRAAVELADVEVDLPDVQIDDINLPEVLVADGSASLTDHGQLGSNTVLVVDDNPDLRRYVSMMLQNAGFNAVLAKNGADGFNKAQTYHPDVIVTDLMMPQVSGLELIRMIRSSPELRGTPIILLTAKADEDTRIEGVERGADAYVSKPFNDRELIAEVRNLQALKAEERRVAHLNKYLTESVLRRFLPESMVKKAAAGDLTLDLRPEPRLITILFSDIVGFTRMSNALQSQGVAELLNEYLGEMTRAVFENQGTVDKFVGDAIMALYGAPEEMSPSEQVRRAIATARQMLVALEKLNQGWQERGLVGRNEVPPVRFRCGIHQGMAVVGLFGSQERSDFTAIGPSVNIAARLQEATAPNSIMVSAMVAQYVPDEEIIKREFLELKGIDEPVMTCVINPNMLNQ

SEQ ID NO: 26463 - protein, 600 aa, Deinococcus radiodurans
  unsure (1)..(600): unsure at all Xaa locations
MCLTTLWHSVEKMRSLSVSLFHLLRRSVTVAVMSESAPNHTSARRLTQPLEPFVGRQVLVGVSGGADSVGLLRALLAVGALPAVAHLDHALRPESVDDAAWVSDLCARLGVPCEVTRIDVGAVAARRNWNLEXAARRLRYDVLSRAAKHSGAEVILTAHTRRDQAETVLMELLRGEGRIRGIPPQRGRVRRPWLNVGRAEIETYLRGLGQDWREDASNADPRFTRAWLRREVMPVLLTRFPAAETALAQVAELGAEDDAALQALAARLTPHTPLDRQPPAVLRRWLAAELRSGGLDFTAEQLRDLAGALNAGQTRHLTLPTGRDVTVTGGHLYTAPCDWPEPDFPLPPDWTRRTRQAGDRIRLAGGTRKLSDVLTDAHLPRAERDRVPLLTDEHGAVQWVGVQPPLWAVGARESLGLPADPLHAAMGEALALAQQAAERQEVPVGAVVLNADGEIVGRGRNTSREDGDMTCHAELAALREAAAGLGTPYLSDCTLVVTLEPCPMCLGAALEARIGHIVYGAANPKAGALGGVSDLLADHWGWRPTVQGGVRAGEAARLLREVFGEVRRRSADTPQTPNAETPAPRSSRSTSASGKPTMLE

SEQ ID NO: 26464 - protein, 261 aa, Streptomyces galilaeus
MPPAAERVAIVTGATSGIGLAVARSLAEGGARVFVCARDGDRVAHTVKELREAGHDVDGASCDVRDTARVRAFVQEARDRFGPVDVLVNNAGRSGGGHTAQIPDELWLDVIETNLNSVFRMTREVLTTGGMLERGAGRIVNIASTGGKQGVALGAPCSASKHGVVGFTKALGLELAKTGITVNAVCPGYVETPMAERVRQGYAGAWDITEDEVLERFEAKIPLGRYSTPDEVAGLVGYLLSSTAASITAQAMNVCGGLGNY

SEQ ID NO: 26465 - protein, 341 aa, Streptomyces coelicolor
IHPDTGLPISTSGADWTSVFGDEMLKLGKEREDVVAITAAMLQPVGLDKFAKAFPDRVYDVGIAEQHGAVSAAGLAHGGVHPVFAVYATFLNRAFDQVLMDVALHKCGVTFVLDRAGVTGTDGASHNGMWDMSILQVVPGLRLAAPRDADQVRAQLREAVVVDDAPTVVRFSKGAVGPAVPAVGRVGGMDVLRAPGTGTPDVLLVSVGALAPMCLEVADLLNKQGISTTVVDPRWVKPVDEAMAPLAERHRVVVTVEDNSRVGGVGSAVAQALRDAGVDVPLRDFGIPPRFLDHASRAEVLAEIGLTAPDIARQVTGLVARLDGRYDRAGAEVDQVEAARD

SEQ ID NO: 26466 - protein, 353 aa, Streptomyces coelicolor
MPLLTRITGPRDLDRLSLEELTQLAEEIRTFLVDAVSKTGGHLGPNLGVVELTLALHRVFESPKDKVLWDTGHQSYVHKLLTGRQDFSKLKMKGGLSGYPSQGESEHDVIENSHASTVLGWADGIAKANQVMERDDHVVAVIGDGALTGGMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREDVVAITAAMLQPVGLDKFAK

SEQ ID NO: 26467 - protein, 315 aa, Streptomyces coelicolor
PLTSLMFAQAATEAGIPDGVINVVSGTGREAGEHLVAHPDVAMTSFTGSTAVGKRVAEVATATVKRLHLELGGKAPFLVFDDADLDAAVHGAVAGSLINTGQDCTAATRAYVQRPLYEAFVEKTAALMDTVRVGDPFAPGTDLGPLVSHVQRDRVAAFVDRARSYARVVTGGEVPQGDLKDGAYYRPTLVADAAQDSEVVQSEIFGPVLVVLPFDTDDEGIRLANDTPYGLAASAWSRDVYRANRATREIKAGCVWINDHIPIISEMPHGGYKASGFGKDMSAYSFEEYTQVKHVMFDNTAVAAKDWHRTVFGDR

SEQ ID NO: 26468 - protein, 368 aa, Streptomyces coelicolor
IVPMSLRAVHFVMPGGVDDPAAPSGGNAYDRRVRLDLPGFGWRVRGLPVPGDWPRPDDAARAELARVLRRLPDGAVVLLDGLVACGVPEVVVPEAERLRMAVLVHLPLGDETGLDPAVAAGLDARERTVLRAVPAVVATSDWAVRRLVSHHGLDPGRVHVAAPGADIAPLAPGTDGVSKLVCVAAVTPRKGQHRLVEALAAVSDLPWSCVCVGGLAQDPEYVDRLRSLIARHGLQERLVLAGPRAGADLDATYAAADLMVLTSYAETYGMAVTEALARGIPVLATDVGGLPEAVGRAPDGGVPGILVPPEDPGALAAELRGWFGEPDVRRRLKAAARGRRAALNGWASTAQSLAGVLHRLPGEPRRAA

SEQ ID NO: 26469 - protein, 217 aa, Streptomyces coelicolor
MTSDFADALASGPLVLDGGLSNQLEAAGHDLGDALWSARLLAEDPEAITRAHLAYFEAGAEVAITSSYQATFEGFARRGIGRERAAELLALSVASAREAARRARTARPERALWVAASAGPYGAMLADGSEYRGRYGLGRGALERFHRPRLEVLAAARPDVLALETVPDTDEAAALLRAVRGLDVPAWLSYTVAGDRTRAGQPLDEAFALAADVDEVI

SEQ ID NO: 26470 - protein, 120 aa, Streptomyces coelicolor
PAWLSYTVAGDRTRAGQPLDEAFALAADVDEVIAVGVNCCAPEDVSGAVETAARVTGKPVVAYPNSGETWDAKSRGWRGRSSYTAERVRDWRERGARLVGGCCRVGPETITSIARALPRE

SEQ ID NO: 26471 - protein, 609 aa, Cyanidium caldarium
MWRKGYVPGFLCPLSSSFSTIQDNTFSHKSCNSCVSLVLVKSRVLFVVQQASSADNRFRAQRLFCPKYCSRTESSFVYSTSGDDSQLGVCRDNPTKVRKVLAVSTLSKEKSTAAVSSKNEPIRNRSKLVNSPESTRNSTRKKQRIQEYVQSGDYSSAQRLEDVLSLESSEDADQYYSNESLVSSSSKSRSSEKYSLMRSSRKNRKSSNVDDMSMEDIHYLEKQEKEILSMAITKEDALLIESIVNRPTTASSKQIKKGSSMGAFLKEIGSVPLLTESQVVSLAREIRKLALWNATRIQLRHEYGKEPDRTEWAKALNMSAEELTRNLLRAQRARESLVAANLRLVVSVAKQFTNRGLSMQDLIQEGSIGLIKGAERFDYRTGFRFSTYAMWWIRQAMQRAIADTSRPIRIPSTITDLSVQIYRARLELSSTLGRDPTDAELADFLDISVQRLQDVKLYTNQSATVSLDAPVSRQVTNTCIKSKGTGDTDVFSSKADGKLSKNGYGSRHKLGDFTLGDTVQTDESVSPEHMMADSLMRDDIECALSLLNPYEREVIRMRFGLDDGRMKSVDEVCAYYCVQTSRIRRIEARALRKLRHPSVWHMLRDYISN

SEQ ID NO: 26472 - protein, 591 aa, Cyanidium caldarium
MDVDYQPRSAYMIAAGSRRTQTHKCGTFEKLQEPGDPDSVLTGIILRSSEGAHQERSDASGLDIIIGTWSPSHRTSALVDPRGLAAYADELLAAADIDIASLTEEGGLAPQNSANQPSRISFPGSLGAYVRGLEQQYRSERMIDRAPSATEIESRKSKKAALKSQNKMTSSRKETRSSSSQARARQQKGRKSEQAPGVPVHMRAGPRTKNTVTVRDPFADNQSANDGSTVPVEEVYSNSETEEAESQIESDELLDFIVEEVDPADVDLSTVEAKDDTIRSYLREIGRYQLLHPGEEIELSKQVCILMDLEQFQRSFREEHGKSPTESEWAQGCGYGDDVEKLREHIRDGRKAKERMVTANLRLVVSIAKRYSNRGVALQDLIQEGSIGLIRGVEKFDAERGFRFSTYATWWIRQSITRAISDSSRSIRLPVHVHDTISLIRKQTKALQVELGRPPSEEEICESVGIDRAKYRLVMECSRNIVSLETPLRSGDDVHFLGESLIAPEERAEENCSRDTLRESIEKVLHCLSTREREVIRMRFGLTDGRPRTLEEVGSRFNVTRERIRQIESKALKKLRTPAENNFLDEYLGEV

SEQ ID NO: 26473 - protein, 599 aa, Volvox carteri
MMRNTLLAIAVLAVAWAAIADAYGEDPFYSFGEYNDYDAPAGEQTGLIPAFPFRNCASKIGAYRFLPNVTQRAPGHFCFTLKVQSCTNQCCGVDLHKIEFNVSDSCIVQPAAEAKATINGVYTRIGAAFGRPVNGRNGTAVLRLTQLGLDTTSAQNAEVCIILKNNRLGKGCTTLEQLCTPPPGYPSGFCAAAIFDTTCECCPISQASTLPLPLPNAPPSPLPPSPPPPPPPSPPPSPPPPPPPPPPSPPPSPPPPPPPPPPPPPPPPPPPPPPPSPPPPPPPPPPPPPPPPPPPPPPPPPPVYPDQCSVCIVAKLQPPAIDVRPYRYDPYACFQIQDAISTQINVALIDNNIHMLSYFVLNYNYCTELETRVCGTFAYAAEAQNFKATAEALMPYFLGSASVGSVCKPELEGYRVEITTEGSTCLDLSGSTSCNAAATPVPSSTCNMAKGTLPFLVSTRYMVNSWSANSTEYCFQVNVLDASQVVPGGCSGDLSQLGEVQLYARRNLSASVHAVRIYPSVGSSSIVTPSWTAIGGAYLFNVPLHWSISQAQDASVCIELDNTKTMLDLCLGFPGQCYVSTVNTNRDCCPSYRTALGLL

SEQ ID NO: 26474 - protein, 190 aa, Picea glauca
MAALSAKMPLLSISKGSTHHGVTAMRSATAAPRVFFRTIPRAGEYGRNAAEEARETADSTAEKSKRMAEEAKERAKGATYEAKEKAKGTTYEAKEKTKSAAEEAGNKAGEMKENAREKAEGLGQRAKETTSQATEKAQNIGDQPKQKVQEAWDMAKGTGQKVKETVVGKAEDTKETVEDKTESAKRKINE

SEQ ID NO: 26475 - protein, 211 aa, Pinus radiata
MDSRPATVLVIIVSAIMASATAKDVNPQHSGTSIAEFIKSSCQVSRYPQLCVSSLSPYAGSLKPTLCDLVKAAMNVSLVNARTVSVWAAGLKGRSAEMSERERAALNDCIQNFDDTVDEIQKSLKELEQLQRSNFNPQMNDMQTFMSAALTDQGSCLNGFEDVKAAAGKISAMVKVRVQNESELISNALALLNALALNAFANTGVDDGIHA

SEQ ID NO: 26476 - protein, 293 aa, Pinus radiata
MGFLYSNIPLIRCAISLVLAIFMLIPGSLCCDSCLYRSKLVYHSQPPLPEIINDASCQYGPYATNLMNSGKQSVATASTKIYRDGKGCGACYQIRCTDPALCTKSGVKVVVTGMSIDDRTDFYVYSPTFLSLARPNKSEQLLNRGAGLDVEYKRVPCEYPGQNMAIKVDESSAYPNFLAVKFLYEGGQTDISAVEVARVGQWRWYSMSARKYSAVWEIANSDLFDGQGQPPSLSFRLLVTGGSEGSWVWQAGRNLLPANWKVGSVYDSGLQITERALEFNCTSCATGDWKDQN

SEQ ID NO: 26477 - protein, 42 aa, Pinus radiata
MRHYVHCYALHCLDIEQSNRLRRAYKERGENVGAWGQACYKP

SEQ ID NO: 26478 - protein, 126 aa, Pinus taeda
MSEEKQHHHLFHHHKEDGGEQVIESTDVYAAGNVDEYEKAKKDEKHHKHMEHLGEMGTVAAGAFALHEKHADKKDPEHAHRHKIEEEVAAAAAVGAGGYVFHEHHEKKESKEEEKEAEGKKHHHLF

SEQ ID NO: 26479 - protein, 153 aa, Pinus taeda
MSEEKHHHHLLHHKKEDESENVPSEVVCAETTTAYGDEVIQSADVYAAGEVNDDKFAEYEKARKEEKHHKHLEELGGLGTVAAGAFALHEKHASKKDPENAHRHKIEEEIAAAAAVGAGGYVFHEHHEKKESKEEEKEAEGKKHHHLFYVRCH

SEQ ID NO: 26480 - protein, 108 aa, Pinus taeda
HHHKEDGESADVRDEGNVKSEEKAKKEEKRHKHLEETGGLGAVATGGFALHEKHEEKKDPEHAERHKIEEEVAAAAATAEGGYVLHERHDVKEDKEKEKEAEGKKHHH

SEQ ID NO: 26481 - protein, 131 aa, Pinus taeda
  unsure (1)..(131): unsure at all Xaa locations
HHKEDENDNPPSEVVYFETTTAYGDEVIQSADVYATGNVNSDEYEKARKEEKHHKHMEEVGGLGXMATGAFALHEKHAEKKDPEHAHRHKIEEEIAAAAAVGEGGYVFHEHHEKKESKEEAEEAQGKKHHH

SEQ ID NO: 26482 - protein, 164 aa, Pseudotsuga menziesii
MSDQYNYTKDSASDATERSKQYGQEKTGQAQGVAQSAQQKSAEAARVTQEKAAEASRAAREKASQATGTTKEKASQATGTTKEEASQATETTKGVGQSAAEKASQAAQAAKEKAQQGKEGTGSILQQAGEKVKGGTQTAMEALKHPLGGSDQGDQGDQGRDRNQ

SEQ ID NO: 26483 - protein, 164 aa, Pseudotsuga menziesii
MSDQYNYTKDSASDATERSKQYGQEKTGQAQGVAQSAQQKSAEAARVTQEKAAEASRAAREKASQATGTTKEKASQATGTTKEKASQATETTKGVGQSAAEKASQAAQAAKEKAQQGKEGTGSILQQAGEKVKGGTQTAMEALKHPLGGSDQGDQGDQGRDRNQ

SEQ ID NO: 26484 - protein, 153 aa, Pseudotsuga menziesii
MSDQYNYTKDSASDATERSKQYGQEKTGQAQGVAQSAQQKSAEAARVTQEKAAEASRAAREKASQATGTTKEKASQATETTKGVGQSAAEKASQAAQAAKEKAQQGKEGTGSILQQAGEKVKGGTQTAMEALKHPLGGSDQGDQGDQGRDRNQ

SEQ ID NO: 26485 - protein, 153 aa, Pseudotsuga menziesii
MSDQYNYTKDSASDATERSKQYGQEKTGQAQGVAQSAQQKSAEAARVTQEKAAEASRAAREKASQATGTTKEKASQATETTKGVGQSAAEKASQAAQAAKEKAQQGKEGTGSILQQAGEKVKGATQTAMEALKHPLGGSDQGDQGDQGRDRNQ

SEQ ID NO: 26486 - protein, 143 aa, Mesembryanthemum crystallinum
MADGEKHHHHLFHHHKDEEKPEAEAVVYSETTYSGDGYGTGYSETTTAVIAEPEKDYAKEERHHKHKEHMGELGAVAAGAFALHEKHKIEKDPEHAHRHKIEEEIAAAARVGAGGYVFHEHHEKKEAKEERKEHEGKHHHHLF

SEQ ID NO: 26487 - protein, 134 aa, Mesembryanthemum crystallinum
MKRNGGNYASLCYLRNVMAVIMVGMIWMNEAMASNSASAFVNNVIYSNRIAVFSKSYCPYSVRAKRVFSDLQERPFVVELDLRDDGSEIQDVLLELVGRRTVPQVFVNGKHIGGSDDLHSAVMSGLLQKHLSTS

SEQ ID NO: 26488 - protein, 172 aa, Mesembryanthemum crystallinum
IGEGTYGKVYRAREKATGKIVALKKTRLHEDDEGVPPTTLREVSLLRMLSRDPHVVRLMDVKQGQNKEGKTVLYLVFEYMDTDLKKYIRSFRSMGQTVPPQNVKSLMYQLCKGVAFCHGHGVIHRDLKPHNLLMDRKDMTLKIADLGLARAFIIPIKKYTHEILTLWYRTPE

SEQ ID NO: 26489 - protein, 120 aa, Beta vulgaris
VSEEYKLVPDTLYLTVNLIDRFLSGNYLEKQKLQLLGVTCMLIASKYEEVSAPQVEDFCYITANTYAREEVLNMERKVLNFLCFQLSVPTIKTFLRRYVHAAQATEDSLVDLEFLAKYLV

SEQ ID NO: 26490 - protein, 549 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSTTVTNDNH

SEQ ID NO: 26491 - protein, 372 aa, Chenopodium rubrum
MAPSFDLLCAEDNSSIFDEVDDNYYGVVDDDVLQICNLQQQHGNLRNFDDFTLILLIIIKEHNFEALISGFFVANHECLASLFDNERQHFLGLDYLKRFRNGDLDLGARNLVIDWIHKVQSHYNFGPLCVYLSVNYLDRFLSAYELPGKAWMMQLLGVACLSLAAKVDETDVPLILDLQVSESKFVFEAKTIQRMELLVLSTLKWRMQSVTPFSFIDYFLYKLSGDKMPSKSLIFQAIQLILSTIKGIDLMEFRPSEIAAAVAISVTQQTQIVEFTDKAFSFLTDHVEKERLMKCVEIMHDLRMSSRSNGALASTSVPQSPIGVLDASACLSYKSDDTSTTPSGSCGNSAHSSPASAPPPKRRKLDRTSQIS

SEQ ID NO: 26492 - protein, 422 aa, Spinacia oleracea
MGSSDDVKSPKSEKTSPPATEHNGVHMYPDWAAMQAYYGPRVALPPYFNSAVAPGHPPPPYMWGPPQPMVPPYGAPYAAIYAPGGVYAHPAIPLASQAHGQEVAPPAVSEPLVATPLSMDTPAKSPKNADKGFIKKLKGFNGLAMSIGNGNTEKTEGDVENRLSQSAESEGSSNGSDGNYTEDADDNKRKRSREGTPISVEAEKTEIKAVLPPPADKVLGIPVTSANAVAGQVMGTVVSPGVATTLELRNPGVTVKGNSSPVSSPNGVVSSEAWLQTQRELKRERRKQSNRESARRSRLRKQAETEELARRVESLSAENMALKSEVNLLVENSQKLRLENAALTGKLKNLQSGQGDENGLANVDTKRNPSDSTENLLSRVNNSSSVGRNSDEGAEMFGKSAKSGAKFHQLLDNRRGDAVAAR

SEQ ID NO: 26493 - protein, 630 aa, Dianthus caryophyllus
MESCDCIDTQWQDKVLVQYQYLSDILIAIAYFSIPLELIYFVKKLAFFPYRRVLMLFGAFIVLCGTTHFINLWTSSVHTKTVAIVMTVAKMSTAAVSCVTALWLVYIIPDLLSVKTREMCLRHKAEELDKEKGLILTQEETERHVRMLMHKIRSTLDRHTILKTALVELGRTFNLEECAIWMPSQTGKTMQLTHALNHSMVVGLTVSTNDSFIDEIFNTSSAVRIPYSCSLVRSMSVAGRYGAPEIVVVRVPLLHHSNFQINDWPDISAKNFAAMVLISPSDAVRKFRDHDLELVKVVADEVAVALSHAATVEESVRAQNQLMEHNVALDLARREAEMAIICARNEFLSVMNHEMRTPIHAIIALSSILLGTELTPEQRVMLEIILKSSNLLSTLINDVLDLSRLEDGSLELDTVVFNLHGVFKEVLHLIKPIASVKKLSLTLVLAPEMPVCAVGDEKRLLQTILNVVGNAVKFTKEGYVSVSASVARPESLTNWRGPEVHPVLSDGYFYLKVQVKDSGCGINPQDMPIIFNKFTQFNQNTAGIGLGLAICKRFVNLMGGQIWIESDGHGKGTTTTFMVKLGTCKSSSDKLSFQVAGQVNQGSSEFISNKRLFRGDDSAGSTFQCYERTF

SEQ ID NO: 26494 - protein, 631 aa, Dianthus caryophyllus
MELCDCIDTQWQDELLVKYQYISDFFIAVAYFSIPLELIYFVQRSAFFPYRWVLMQFGAFIVLCGATHLINLWTFSMHTKNVAIVMTIAKMATAAVSCVTALMLVHIIPDLLSVKTREMFLRHKAEKLDKERGLILTQEETGRHVRMLTHEIRSTLDRHTILKTTLVELGRTLNSEECALWTPSQTGMTMRLSHTLNHSMVVGSTVSMNLSVISEVFNNTGAVRIPHTCPLVRTRPVSDRYRAPDVVAVRVPLLHHSNFQINDWPDNSAKNYAVMVLISPSDGIRKFRDHELELVEVVADQVAVALSHAAILEDSMRARDQLMEQNVALDLARREAEMAIRARNDFLAVMNHEMRTPMHAIISLSSILLETELTPEQRMMLEIILKSSNLLSTLINDVLDLSRLEDGSLELDPTVFNLHAVFTEVIQLIKPIASVKKLSLTLGLAPEVPVYAVGDEKRLMQTILNVVGNAVKFTKEGFISVSASVARPESLTDWRASEFYPDLTDSQFYLRVQVRDSGCGINPQDIPLIFNKFTQFNRNSNGIGLGLAISKRFVNLMGGQIWIESDGHDKGSISTFVVKLGTCKGSSDTLTPATVRTHSEHGNTEFISNKQLFRGDDSINSIFKPYERSFR

SEQ ID NO: 26495 - protein, 266 aa, Gossypium barbadense
LSVEEIEVAPPQKNEVRVKIHFTSLCHTDVYFWEAKGQNPLFPRILGHEAEGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 26496 - protein, 272 aa, Gossypium barbadense
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 26497 - protein, 265 aa, Gossypium hirsutum
LSVKEIEVAPPQKNEVRVKIHFTSLCHTDVYFWEAKGQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQELIAEMTGGVDCSIECTGSTQAMVSAFECVHD

SEQ ID NO: 26498 - protein, 266 aa, Gossypium hirsutum
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 26499 - protein, 221 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 26500 - protein, 974 aa, Gossypium hirsutum
MMESGVPVCHTCGEHVGLNVNGEPFVACHECNFPICKSCFEYDLKEGRKACLRCGSPYDENLLDDVEKATGDQSTMAAHLNKSQDVGIHARHISSVSTLDSEMAEDNGNSIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVICEIWFAFSWVLDQFPKWYPVNRETYIDRLSARYEREGEPDELAAVDFFVSTVDPLKEPPLITANTVLSILALDYPVDKVSCYISDDGAAMLTFESLVETADFARKWVPFCKKFSIEPRAPEFYFSQKIDYLKDKVQPSFVKERRAMKRDYEEYKIRINALVAKAQKTPDEGWTMQDGTSWPGNNPRDHPGMIQVFLGYSGARDIEGNELPRLVYVSREKRPGYQHHKKAGAENALVRVSAVLTNAPFILNLDCDHYVNNSKAVREAMCFLMDPQVGRDVCYVQFPQRFDGIDRSDRYANRNTVFFDVNMKGLDGIQGPVYVGTGCVFNRQALYGYGPPSMPSFPKSSSSSCSCCCPGKKEPKDPSELYRDAKREELDAAIFNLREIDNYDEYERSMLISQTSFEKTFGLSSVFIESTLMENGGVAESANPSTLIKEAIHVISCGYEEKTAWGKEIGWIYGSVTEDILTGFKMHCRGWRSIYCMPLRPAFKGSAPINLSDRLHQVLRWALGSVEIFLSRHCPLWYGFGGGRLKWLQRLAYINTIVYPFTSLPLIAYCSLPAICLLTGKFIIPTLSNLASVLFLGLFLSIIVTAVLELRWSGVSIEDLWRNEQFWVIGGVSAHLFAVFQGFLKMLAGIDTNFTVTAKAADDADFGELYIVKWTTLLIPPTTLLIVNMVGVVAGFSDALNKGYEAWGPLFGKVFFSFWVILHLYPFLKGLMGRQNRTPTIVVLWSVLLASVFSLVWVRINPFVSTADSTTVSQSCISIDC

SEQ ID NO: 26501 - protein, 301 aa, Gossypium hirsutum
MASSWFFIVFLVLTVASVRCTTVDHMPSTDEDARDYSKLKTKTEEATDEHHSRTQQAKDELKSKADHAANEVKSNTQQAKDRASEVGKEAKEYTESWTEWAKEKISEGLGFKQDDDPKGSVEKAFDSVADTATKTKDKLQDMASGAGEYSAGKAKDMKDTAYKTDDVKNAAKGKSSEMRQATTEKARELADSAKENANTAYIAAKEKVRDMADRTSEMTNEAQERGARKAEEAKEVVAEKAEGAAEETKKKNEERGESLKWAKEKAKQGYDAAKSKAEETIESAKDTIASGYESRSRNHKN

SEQ ID NO: 26502 - protein, 637 aa, Cucumis melo
MMESCDCIDAQWPPDELLVKYQYISDVLIALAYFSIPLELIYFVQKSAFFPYRWVLMQFGAFIVLCGATHFINLWTFSMHSKAVAVVMTVAKVACAIVSCATALMLVHIIPDLLSVKTRELILKNKAEQLDREMGLILTQEETGRHVRMLTHEIRSTLDRDTILKTTLVELGKTLGLEECALWMPSRNGLSLQLSHALNYQIPVGTNIPINLPVVNDVFNSNRAICVPYTCQLARVRTPVGGRYLPPEVVAVRVPLLNLSNFQMNNWPDGSSRSYAIMVLILPTDSARKWRDHELELVDVVADQVAVALSHAAILEESMRARDQLVDQNVALDLARREAETAIHARNDFLAVMNHEMRTPMHAIIALSSLLLETELTPEQRVMIETILKSSNLLATLINDVLDLSRLEDGSLVLDMGSFNLHAIFKEALDLIKPIASVKKLSMALILASDLPICAVGDEKRLMQIILNIVGNGVKFTKEGHVSIIASIAKLDSLRDWRPTEFYPMQSDGQFYLRVQVKDSGCGIPPQDIPHLFTRFTQLQTRSNKTNSGVGLGLALCKRFINLMGGHIWIESEGPDKGTTAMFIVKLGICNANPNDLSVKQVAPIVNHRSADLHGQRPIFRETGQVAFSNSRYQRSL

SEQ ID NO: 26503 - protein, 484 aa, Cucumis sativus
MVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 26504 - protein, 509 aa, Cucumis sativus
MAKKDDSATRPPLQRPTITLPPRPSMEAFFTGVPTGVSPGPMTLLSSYLADFADGAVDSPSFSQLLAGAMASPMAMGFFGTGSTPNYYAKDGPASELEFGMKQSKPVNLVVARSPLFSVPPGLSPSGLLNSPGFYPPQSPFGMSHQQALAQVTAQAALANSHMHMQQAEYQHSSVPAPTEPLVRDPSFSLDDASQLAIIPSTSDTKSLIAESTEVSHSDRKYQPPPPPHGSDKPADDGYNWRKYGQKLVKGSEFPRSYYKCTHLNCPRKKKIEGLPDGEITEIIYKGQHNHEPPPANKRARDNIEPAGCTNSLIKPECGLQNQAGILNKSSENVQLGSSDSEGRADTEITDDRDEDEPNPKRQNIDAGTSGVALSHKTLTEPKIIVQTRSEVDLLDDGYRWRKYGQKVVKGNPNPRSYYKCTSAGCNVRKHVERSSTDSKAVVTTYEGKHNHDVPAARNSSHHTVNNTVHHIKPLKVVAQKHPLLKEMEFGTNDQRPAVLQLKEEQITV

SEQ ID NO: 26505 - protein, 380 aa, Cucurbita maxima
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 26506 - protein, 958 aa, Arabidopsis thaliana
MMESRSPICNTCGEEIGVKSNGEFFVACHECSFPICKACLEYEFKEGRRICLRCGNPYDENVFDDVETKTSKTQSIDSGIHARHISTVSTIDSELNDEYGNPIWKNRVESWKDKKDKKSKKKKKDPKATKAEQHEAQIPTQQHMEDTPPNTESGATDVLSVVIPIPRTKITSYRIVIIMRLIILALFFNYRITHPVDSAYGLWLTSVICEIWFAVSWVLDQFPKWSPINRETYIDRLSARFEREGEQSQLAAVDFFVSTVDPLKEPPLITANTVLSILALDYPVDKVSCYVSDDGAAMLSFESLVETADFARKWVPFCKKYSIEPRAPEFYFSLKIDYLRDKVQPSFVKERRAMKRDYEEFKIRMNALVAKAQKTPEEGWTMQDGTSWPGNNTRDHPGMIQVFLGYSGARDIEGNELPRLVYVSREKRPGYQHHKKAGAENALVRVSAVLTNAPFILNLDCDHYVNNSKAVREAMCFLMDPVVGQDVCFVQFPQRFDGIDKSDRYANRNIVFFDVNMRGLDGIQGPVYVGTGTVFRRQALYGYSPPSKPRILPQSSSSSCCCLTKKKQPQDPSEIYKDAKREELDAAIFNLGDLDNYDEYDRSMLISQTSFEKTFGLSTVFIESTLMENGGVPDSVNPSTLIKEAIHVISCGYEEKTEWGKEIGWIYGSITEDILTGFKMHCRGWRSIYCMPLRPAFKGSAPINLSDRLHQVLRWALGSVEIFLSRHCPLWYGCSGGRLKLLQRLAYINTIVYPFTSLPLVAYCTLPAICLLTGKFIIPTLSNLASMLFLGVSIEDLWRNEQFWVIGGVSAHLFAVFQGFLKMLAGLDTNFTVTSKTADDLEFGELYIVKWTTLLIPPTSLLIINLVGVVAGFSDALNKGYEAWGPLFGKVFFAFWVILHLYPFLKGLMGRQNRTPTIVILWSILLASVFSLVWVRINPFVSKTDTTSLSLNCLLIDC

SEQ ID NO: 26507 - protein, 676 aa, Arabidopsis thaliana
MERKTIDLEQGWDYMQTGITKLKRILEGLNEPAFDSEQYMMLYTTIYNMCTQKPPHDYSQQLYDKYREAFEEYINSTVLPALREKHDEFMLRELFKRWSNHKVMVRWLSRFFYYLDRYFIARRSLPPLNEVGLTCFRDLVDKEREGEQIDRALLKNVLDIYSEECLKKERERVAHYLHSSSEPKLVEKVQHELLVVFASQLLEKEHSGCRALLRDDKVDDLSRMYRLYHKILRGLEPVANIFKQHVTAEGNALVQQAEDTATNQVANTASVQEQVLIRKVIELHDKYMVYVTECFQNHTLFHKALKEAFEIFCNKTVAGSSSAELLATFCDNILKKGGSEKLSDEAIEDTLEKVVKLLAYISDKDLFAEFYRKKLARRLLFDRSANDDHERSILTKLKQQCGGQFTSKMEGMVTDLTLARENQNSFEDYLGSNPAANPGIDLTVTVLTTGFWPSYKSFDINLPSEMIKCVEVFKGFYETKTKHRKLTWIYSLGTCHINGKFDQKAIELIVSTYQAAVLLLFNTTDKLSYTEILAQLNLSHEDLVRLLHSLSCAKYKILLKEPNTKTVSQNDAFEFNSKFTDRMRRIKIPLPPVDERKKVVEDVDKDRRYAIDAAIVRIMKSRKVLGHQQLVSECVEQLSRMFKPDIKAIKKRMEDLITRDYLERDKENPNMFRYLA

SEQ ID NO: 26508 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDYGFDMEETLVEAIYTAEQSENAFYMHDEAMFEMPSLLANMAEGMLLPLPSVQWNHNHEVDGDDDDVSLWSY

SEQ ID NO: 26509 - protein, 380 aa, Arabidopsis thaliana
MGSNEEGNPTNNSDKPSQAAAPEQSNVHVYHHDWAAMQAYYGPRVGIPQYYNSNLAPGHAPPPYMWASPSVLILNLLNPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQRYIESNVVLISTSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 26510 - protein, 291 aa, Arabidopsis thaliana
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRM

SEQ ID NO: 26511 - protein, 354 aa, Arabidopsis thaliana
MSNFTYTSAFNLSDNSPFNPAIGSSSSSSSALVVASDDDNNTDDACSICLEPFTLQDPSTEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQVSDFSRTSQTKNLCSKCYNDFLKDESARYLATFNVNTKAAEEVTAQEATVLGSKGGCGEEEG

SEQ ID NO: 26512 - protein, 680 aa, Arabidopsis thaliana
MATINDIGVAAAINIVTAFAFLLAFAIFRIQPVNDRVYFPKWYLKGLRSSSIQTGGFGSKFINLDFRSYIRFLNWMPEALKMPEPELVDHAGLDSVVYLRIYLLGLKIFFPIACVAFTTMVPVNWTNKGLDRLRHSNISFSDIDKLSLSNIPNGSPRSLSHFPGIIIFGFSIVYISDLISELMMVDLLLTQAVHDATKLSELVLTRKQMQNLLDYNINKHMRNLSNRPVIKISEEKQRLRTGTKSIVPAAFVSFKSRWGAAVCAQTQQTRNPTEWLTEWAAEPRDIYYDNLALPYVDLKIRRLIVGVAYFFLTFFFMIPIAFVQSLANIEGIEKAFPFLKPLIEVYVSVYLNMKLLKSIIQGFLPGIALKIFLLFLPRILMQMSKFEGFVSTSSLERRAATRFYMFQFINVFLGSIVTGTAFQQLNSFLNQSANDIPKTIGVSIPMKATFFITYIMVDGWAGVAGEILRLKPLIIYHLKNSFLVRTEKDREEATDPGTIGFNTAVSPILLPFILVFFGLAFVVYRHQVINVYNQKYESAGKFWPDVHRRVVTALVVSQLLLMGLLSTKHASKSTPLLLVLPLLTIGFHKHCKNRYQPAFVTYPLQEAMIKDTLDRIREPNLNLKAFLRDAYAHPEFRVGEDPEPEEKLESDMSPPDLVATKRWSWRNTPLPSKDSCREIP

SEQ ID NO: 26513 - protein, 292 aa, Arabidopsis thaliana
MASSSSSSYRFQSGSYPLSSSPSLGNFVERIKDACHFLVSAVLGTIISAILTFFFALGLFSFLVTLLEIVLGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPILTSQFRYFYSSYIKSLLCSSSLLLEFHSHCRTPSSLMYKETQK

SEQ ID NO: 26514 - protein, 340 aa, Arabidopsis thaliana
MGFIDGKWAPMIVLIVSNMIAGMVNALVKKVLDGGINHMVIATYRLGISTLFLLPVAYFWERASLMQYFYLLGLSYTSATLGSAFWAIMPSLTFVMALIFGFEKLSLKTKIGYGVVLGTLISLVGGLLLTMYQGIPLTNSPEQAANSNNHTGHENWIKGCFFLLTGVVLFSSWMLIQAKINVKYPCPYSSTVILSVFGTLQCALLSLIKTRHLEDWILRDELTIITVVIAGVVAQGMCTVGMSWCIKQQGPVVSSSFSPVVLMSATVFDFLILHREIYLGSVIGSVVVVIGLYIFLWSRSKQIVECKIMKLPTNTVEEEKEEEGRTNVNNGQLLVIPMTP

SEQ ID NO: 26515 - protein, 393 aa, Arabidopsis thaliana
MLLLVDCSSCRTPLHLPPGATRIRCAICHAFTLIAPEPRLQSHASASPFPFPNSSPAPSTFIYPPPTPSPYTHAPHAPSPFNHAPPDSYPFTHAPPASSPFNHAPPGPPPPVHGQKRAVIVGVSYKNTKDELKGCINDANCMKFMLMKRFQFPESCILMLTEEEADPMRWPTKNNITMAMHWLVLSCKPGDSLVFHFSGHGNNQMDDNGDEVDGFDETLLPVDHRTSGVIVDDEINATIVRPLPYGVKLHAIVDACHSGTVMDLPYLCRMDRLGNYEWEDHRPKTGMWKGTSGGEVFSFTGCDDDQTSADTPAIERGHGMTYGSLLNAMRSTVHEIFDKNKGRELVEVGGADFLSTLLGLLILGASPPDEEEEVNQAPQKTQVIHSSILIIFI

SEQ ID NO: 26516 - protein, 327 aa, Arabidopsis thaliana
MAAQVEIEDQESVTNLDNGEIINPISDNAPNFSGDATILLREATFEHNLIKNCFLSGMGSFATETTIVTVRKILTQRLITTKAKFAVFKLFTEAMKRKNNGYANIRYGWYSGSKEEIDRVITYGFSNREIKKVENDVGSHGVGIHLVHHRYSLAAALVGEGDEEGIKNILLCRVILGKPEQIVTGSKQSYPSSNQFDSGVDNLENPRKYVIWSCNMNSYILPTYIVSFKSHLLRGLIGRARSPCVSFSVLMSILSKSLDAARMNLILTSYDDFRKRKLRREQLVRKIREVDVTDLPELAKVQQQLMIRNGVGLKQEETHIFTHRIYI

SEQ ID NO: 26517 - protein, 454 aa, Arabidopsis thaliana
MGEIVVLSSDDGMETIKNRVKSSEVVQWEKYLPKTVLRVLLVESDYSTRQIITALLRKCCYKGRLVFPFISLFVAVSDGLAAWEVLKEKSHNIDLILTELDLPSISGFALLALVMEHEACKNIPVIMMSSQDSIKMVLKCMLRGAADYLIKPMRKNELKNLWQHVWRRLTLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRDTQASS

SEQ ID NO: 26518 - protein, 753 aa, Arabidopsis thaliana
MEWDSDSDLSGGDEVAEDGWFGGDNGAIPFPVGSLPGTAPCGFVVSDALEPDNPIIYVNTVFEIVTGYRAEEVIGRNCRFLQCRGPFTKRRHPMVDSTIVAKMRQCLENGIEFQGELLNFRKDGSPLMNKLRLVPIREEDEITHFIGVLLFTDAKIDLGPSPDLSAKEIPRISRSFTSALPIGERNVSRGLCGIFELSDEVIAIKILSQLTPGDIASVGCVCRRLNELTKNDDVWRMVCQNTWGTEATRVLESVPGAKRIGWVRLAREFTTHEATAWRKFSVGGTVEPSRCNFSACAVGNRIVIFGGEGVNMQPMNDTFVLDLGSSSPEWKSVLVSSPPPGRWGHTLSCVNGSRLVVFGGYGSHGLLNDVFLLDLDADPPSWREVSGLAPPIPRSWHSSCTLDGTKLIVSGGCADSGALLSDTFLLDLSMDIPAWREIPVPWTPPSRLGHTLTVYGDRKILMFGGLAKNGTLRFRSNDVYTMDLSEDEPSWRPVIGYGSSLPGGMAAPPPRLDHVAISLPGGRILIFGGSVAGLDSASQLYLLDPNEEKPAWRILNVQGGPPRFAWGHTTCVVGGTRLVVLGGQTGEEWMLNEAHELLLATSTTANSCLKTFSFIFSQFNTFKMPINKDPSTPPPVIGKIGPYTVFMTPPATPKPPESPSAVSQKPVMAPPVLPPPQQFKSVASSDQDGSVLGFFKNAVTKVQNAHSSVDDHLVRWFGLNQSKYQWALDEYYESKESANEHNNIQPMKLIQHI

SEQ ID NO: 26519 - protein, 170 aa, Arabidopsis thaliana
MRILCDACENAAAIIFCAADEAALCRPCDEKVHMCNKLASRHVRVGLAEPSNAPCCDICENAPAFFYCEIDGSSLCLQCDMVVHVGGKRTHGDKPKENNTRDNLQNQRVSTNGNGEANGKIDDEMIDLNANPQRVHEPSSNNNGIDVNNENNHEPAGLVPVGPFKRESEK

SEQ ID NO: 26520 - protein, 481 aa, Arabidopsis thaliana
MESKWLFGRKQEAEVGPFSAWNITGTYRDYLSNVKRVFSGTWKFLNSLNSSSKFQDFQKENGNSVVELVAVPTKITGVHYVQGVVVFHDVFDNEQNVGGAQINLEAWNFLLSSVSRISKRQITETETFNTDLQFSCTSAPVNEMEKHCNIEIAAQVSRVASSENSMHSNFKHRSDLDGDKNYYHMEGLMESPGVGDDGDCFSPLLLNATSVNVEVYYNKAVNYTLMFHNYMQPILLLMYSFWIPQIVANVVRDSRKPLHPYYILGMTATRLAIPLYVFGCPHNFMRVEPNKVWCICLCTFMGLQAVILLLQHYFGSRCFVPRQFGLNISSLVPIAKLFLTTTNLFLHRFAYTQMLPEKYNYHRRFNRDVSRTTDCVICMTAIDLRQHTSDCMVLQFFPASLNYIFSPIDRIMSVVVLKTEMDGYKNGVSNLSAVSSSSIEDVFGLLGCTDFTQIIAAGPGAMEGPAVDGATSGAMGEHSWS

SEQ ID NO: 26521 - protein, 681 aa, Arabidopsis thaliana
MVGFPANQAKTVEEELPLQVVADQDPKVKTFKDSFDFPSIDSFPDFDSITWSESNRNVEDFSIEDTDFDFFEYHMEIPQEDVVTVSDVMCPENQTTVNSESIEGKLEVFNDDMSGEVGVSSVRSESMVEVKPVLCDVMSEEVGVSSVEVEPNVCVEMSANGGDEPAVKDSEPVVSENSRSMEGETEPVVVSDASVACPTMDLDESGLKKTDEGLACSIEVGLEKDDDLGLQTKEPIRSKNELKELPPVPPVDVTLEPHHATLPVGVVLSVMSAQVIVEGMEKHSPLTEGSILWITEKRTPLGLVDEIFGPVKCPYYIVRFNSESEVPEGVCQGTPVSFVADFAQHILNIKELQKKGYDASGDNDEEIPDELEFSDDEKEAEYRRMQKLEKRGMMSDQKTGNTRNKKKKNRDPGRPTSSYSGEWTKNQGSSSLSSNRSDPQMGGPRPQMDGFPPNNAAWRPQSNQQNPYQLPPIPNQMGMQIPFMAMQNQNQMMFQPQFNGGQMPMPGGPGGLNFFPGQASAPWPAMVGQNCFNQQFGMGRGIQQQPLPNELSFNMFSQGLQMHPPQSQMHRPQSQMNPQFQMPPQFQPHQQSPMNPQYQMMHRPQSPANPQFQMQAQSDVRPLQSQIPQSPSDLQSPMEPQSQGFSSGQSSERGRGFHGRGRGRGRGRFGRGRGRGRQQSG

SEQ ID NO: 26522 - protein, 270 aa, Arabidopsis thaliana; identical to SEQ ID NO: 1215

SEQ ID NO: 26523 - protein, 342 aa, Arabidopsis thaliana
MSATTSKTDQKAALDIASWLFNVVTSVGIILVNKALMATYGFSFATTLTGLHFGTTTLLTTFLTWLGYIQPSQLPWPDLLKFVLFANFSIVGMNVSLMWNSVGFYQIAKLSMIPVSCLLEVMLDNVRYSRDTKLSILLVLAGVAVCTVTDVSVNLNGFLAAAIAVWSTALQQYYVHYLQRKYSLGSFNLLAHTAPVQAASLLLVGPFLDYWLTNQRVDAYNFSFVSLLYLTQFFGQFFLILSCSIAVGTNLSQFICIGRFTAVSFQVLGHMKTILVLVLGFTFFGKEGLNLQVVLGMLIAILGMIWYGNASSKPGGKERRSLSIPITKSQKLSETNESDEKV

SEQ ID NO: 26524 - protein, 760 aa, Arabidopsis thaliana
MATLADIGLAAAINILSALIFLLLFAILRIQPFNDRVYFPKWYLKGVRSSPVNSGAFVSKIMNLDFRSYVRFLNWMPDALKMPEPELIDHAGLDSAVYLRIYLIGLKIFGPIALLSWSILVPVNWTSDGLQLAKLRNVTSSNIDKLSISNVERGSDRFWLGTYHRTQTSRLAKTCSISFLLTTQTIILHIRLDHSIKGMNISLGLLLFVKYFRLIYIQVVYNANELAKLVEDKKKMQNWLDYYQLKYTRNKEQRPRVKMGFLGLWGKKVDAMDHYTAEIEKLSEQIMEERKRIKKDDKSVMQAAFVSFKTRWGAAVCAQTQQTKNPTEWLTEWAPEAREMYWPNLAMPYVSLTVRRFVMHIAFFFLTFFFIIPIAFVQSLASIEGIEKSAPFLSPIVKNKLMKSLIQGFLPGIVLKLFLIFLPTILMIMSKFEGFISISSLERRAAFRYYIFNLVNVFLGSVITGSAFEQLDSFLKQSANDIPRTVGVAIPIKATFFITYIMVDGWAGVAGEIFRLKPLVIFHLKNFFFVKTEKDREEAMDPGQIDFYATEPRIQLYFLLGLVYAPVTPVLLPFIIFFFGFAYLVFRHQIINVYNQKYESAGAFWPDVHGRIISALIISQILLLGLMSTKGKVQSTPFLLVLAILTFGFHRFCKGRYESAFVINPLQEAMIKDTLERAREPNLNLKGFLQNAYVHPVFKDEEDSDEEGLIEDSDDEDCVVVQTKRQRSRRTTVASSNASRGSSQSTPFNQLDLGKGKPET

SEQ ID NO: 26525 - protein, 238 aa, Arabidopsis thaliana
MSHYIRPTFVRIVKKKSVEEYSPIPYLATLINCLVWVLYGLPTVHPDSTLVITINGTGILIEIVFLTIFFVYCGRQKQRLIISAVIAAETAFIAILAVLVLTLQHTTEKRTMSVGIVCCVFNVMMYASPLSVMVRNKMVIKTKSVEFMPFWLSVAGFLNAGVWTIYALMPFDPFMAIPNGIGCLFGLAQLILYGAYYKSTKRIMAERENQPGYVGLSSAIARTGSEKTANTNQEPNNV

SEQ ID NO: 26526 - protein, 901 aa, Arabidopsis thaliana
MPLKEDDCCLFAEEYDGPPLSYNIPCAVPINVEKIPVAAVVSPVCISDNMSFPVIQPILSVESKKFLIDSVSPTSVIANCGSNQLELVSDSITVSPTSVIEHTEEEEEEEGGDGEDCELSSSGELLLRSCSVKESLDLNESSSNPLVPDWESNESVLSMDYPSSRVTGDCVSETNGDGKKQPVVTFLGIASDDGFEEEESCSNLRRVRVVPVKKQPQTKGKKGSCYRCFKGSRFTEKEVCLVCDAKYCNSCVLRAMGSMPEGRKCVTCIGFPIDESKRGSLGKCSRMLKRLLNDLEVKQIMKTERFCEANQLPAEYVYVNGQPLYPEELVTLQTCSNPPKKLKPGDYWYDKVSGLWGKEGEKPYQIISPHLNVGGPISPEASNGNTQVFINGREITKVELRMLQLAGVQCAGNPHFWVNEDGSYQEEGQKNTKGYIWGKAGTKLLCAVLSLPVPSKSTANASGEQLYSANSRSILDHLEHRTLQKILLVGNSGSGTSTIFKQAKILYKDVPFLEDERENIKVIIQTNVYGYLGMLLEGRERFEEEALALRNTKQCVLENIPADEGDAKSNDKTVTMYSIGPRLKAFSDWLLKTMAAGNLGVIFPAASREYAPLVEELWRDAAIQATYKRRSELGLLPSVASYFLERAIDVLTPDYEPSDLDILYAEGVTSSSGLACLDFSFPQTASEENLDPSDHHDSLLSSKTFEDIFLCAFRYQLIRVPSRGLGENCKWIDMFEDVGMVVFVVSMSDYDQVSEDGTNKMLLTKKLFESIITHPIFENMDFLLILNKYDLLEEKVERVPLARCEWFQDFNPVVSRHRGSNNGNPTLGQLAFHFMAVKFKRFYSSLTGKKLFVSSSKSLDPNSVDSSLKLAMEILKWSEERTNICMSEYSMYSTEPSSFSN

SEQ ID NO: 26527 - protein, 624 aa, Arabidopsis thaliana
MGSFQIFVFQKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLRQMTKQSVTLQTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRRFVGRWLSGLRSSKGKRDAGEEQEDDTRRYQLAPIRCSTSLNQLVMQDNKQNCRLNKSKEPETNTFESQSRESPLEVGIGSFLLYLVVASKTELDKMTNLRMQMEMFLLNAKEQLQKKDTPMSSNEASGFQFSPQEFSNLASSIFQESSSSVLQEEYTEFEVSEPEDYRRGTDCNSKLQAEVGRLPLGEKAEDRQTKHQIQRQCKLKDNEVTKSHIPEMVVSDERYGVCPYELDKKLHELLETRQQEELVKLETALNRVERRLQEKETEVSWWKDAARLLAQRVPESSRSGLEWCNPDSSTCSERSVPRSYEACSIHRTSFSR

SEQ ID NO: 26528 - protein, 455 aa, Arabidopsis thaliana
MQFNIREFFFLWLITYCLTFEKCRYHFDGTPRKFFEGWYFRVSIPEKRESFCFMYSVENPAFRQSLSPLEVALYGPRFTGVGAQILGANDKYLCQYEQDSHNFWGDRHELVLGNTFSAVPGAKAPNKEVPPEEFNRRVSEGFQATPFWHQGHICDDGRTDYAETVKSARWEYSTRPVYGWGDVGAKQKSTAGWPAAFPVFEPHWQICMAGGLSTGWIEWGGERFEFRDAPSYSEKNWGGGFPRKWFWVQCNVFEGATGEVALTAGGGLRQLPGLTETYENAALVCVHYDGKMYEFVPWNGVVRWEMSPWGYWYITAENENHVVELEARTNEAGTPLRAPTTEVGLATACRDSCYGELKLQIWERLYDGSKGKLKVLTNPKAVKEDYERLLWLTMMQVILETKSSMAAVEIGGGPWFGTWKGDTSNTPELLKQALQVPLDLESALGLVPFFKPPGL

SEQ ID NO: 26529 - protein, 518 aa, Arabidopsis thaliana
MVKKLTPTKKGSYEEEVAQHTFFPFLLVSLSPQEYLLCRGLSTLFDRGAQEASLLSLSLSSMPSSATSTYLLSLKQVSLTASSPLLLQLKDRFFHQPKLLNMGFSTGKRKSRDEEEDRVSFFASEFPMDDLNDDVLERVLSWLPTSCFFRMSSVCKRWKSSQTSKSFKLACSQIPTRDPWFFMIDNDSNSSSFVFDSTENSWKNLNRRDFLHHHRQDFIPVASSGGLLCYRCSISGDFLLRNPLTGSSRDIPSQDNNNNKPLQAVAMTTTTVTPSSYTLVTISGEIPNLSFKIYESNADSWSKDQELESVKNNDSSLHDDYDTDSGTVYFLSKQGNVVVASNNLQRSPSKQYSSVITVTDEAEIVYFLSSYGTIVACDLTKRCFTELPKLLLPFLEYSIDLVECEGTMYVILLSEFFESASLRIWRLDNNREWVQVGMLPPALSHELYGKKGDINCVGGAGNKILVCFNASPPEVYCRYFVYDLVAEEWNELPKCFKDGEAVDFVSALSFQPRIEATV

SEQ ID NO: 26530 - protein, 300 aa, Arabidopsis thaliana
MSEGDLAVMKPETMKSYIWLQTADGSIQQVEQEVAMFCPMICQEVIQKGVGSSKNHAISLPQRVNPAMFSLILDYCRFHQLPGRSNKERKTYDERFIRMDTKRLCELTSAADSLQLKPLVDLTSRALARIIEGKNPEEIREIFHLPDDLTEEEKLEPLKNSMDDPRIRLLNRLYAKKRKELKERERLKNVEVEEHVDERSVDDLLSFINGRDHKAVKMSKGKKKKKKKKDQKIVSSNNIHDKESHDLRSKQQCVEEIGSSMREVPNLLSAEDDISTPNAGSEDEDIDDEIDPAMRELLDR

SEQ ID NO: 26531 - protein, 249 aa, Arabidopsis thaliana
MSHYIRPTFVRIVKKKSVEEYSPIPYLATLINCLVWVLYGLPTVHPDSTLVITINGTGILIEIVFLTIFFVYCGRQKQRLIISAVIAAETAFIAILAVLVLTLQHTTEKRTMSVGIVCCVFNVMMYASPLSVMVQVIVSSLTLFPIFKMVIKTKSVEFMPFWLSVAGFLNAGVWTIYALMPFDPFMAIPNGIGCLFGLAQLILYGAYYKSTKRIMAERENQPGYVGLSSAIARTGSEKTANTNQEPNNV

SEQ ID NO: 26532 - protein, 344 aa, Arabidopsis thaliana
MVNPVIGAEIKCPFCQSGFVEEMSREINGGSSSSLREVQDPEIDFGTDRALSLWGPILLGMMSNPRRRRRFRRTEFGVDNDEVNVSDDVDGNDSVDIDRHHHRRHRHRQQGREIDLDREFESILRRRRRSSATILQLLQGIRAGIASEYESSDRDLLNQSAVVQGSTSLNQNRNNTSLSAIGDYFVGSSLDHLLEHLADNDSIRHGSLPARKEVVDNLPTVKISESLQCSICLDDFDKGSEAKEMPCKHKFHIRCIVPWLELHSSCPVCRYELPPDDETKVNPVRPRTRTLEINVSNENVEDDARNSNVSERRFSFPWPFSGLFSSSSSSSASASGSSHLGENS

SEQ ID NO: 26533 - protein, 368 aa, Arabidopsis thaliana
MDKLKPIIAIISLQFGYAGMYIITMVSFKHGMNHWILATYRHVVATIVIAPFALILERKIRPKMTWPLFLRILALGFLEPLLDQNLYYIGMKATSATYSSAFVNALPAITFIMAVIFRIETVNLKKTRSLAKVIGTAITVGGAMVMTLYKGPAIELFKTAHSSLHGGSSGTSSETTDQNWVTGTLAVMGSITTWAGFFILQSFTLKKYPAELSLVMWICAMGTVLNTIASLIMVRDVSAWKVGMDSGTLAAVYSGVVCSGMAYYIQSIVIRERGPVFTTSFSPMCMIITAFLGVLVLAEKIHLGSIIGAIFIVFGLYSVVWGKAKDEVISVEEKIGMQELPITNTSTKVEGGGITSEVNEGVTNNTQV

SEQ ID NO: 26534 - protein, 398 aa, Arabidopsis thaliana
MNLVVLLILTLLLFIVSYVVDAGQVILVDSNITRSFVDMEADFSPSVTTVETGVVYVAEPLNACRNLRNKPEQSPYGTSPLVLIIRGGCSFEYKVRNAQRSGFKAAIVYDNVDRNFLSAMGGDSDGIKIQAVFVMKRAGEMLKKYAGSEEMEVMLVPPNTEDSVWSLYASIALILSLAIFCVMVTCVFFYRYCSTIRNSTSQFNGMCRRTVKAMPSVTFTCAKIDNTTEFHVACVDSWLISWRTFCPVCKRDARTTADEPLATESTPFLSSSIATSSLVCIDSPPLGSSVSFSPAHVSSSFIHQFVRSSPMNGSRISENLRRQASPLQSSSQRSHLSMKSSHSLGYSTMSPLNAMGMSPYRPYPSNASPGLFSSTNHLLSNYTANTFSHFASAHSLPD

SEQ ID NO: 26535 - protein, 406 aa, Arabidopsis thaliana
MAENRQLVCRIGGGAGAELDDMDEGEIQRIGNEDEDDDEFIQVHANNSSAASPERWDVLGLGQAMVDFSGVVDDEFLKKLGLEKGTRKLINHEERGKLLQAMDGCSYKAAAGGSLSNTLVALARLGSQSICDRPLNVAMAGSIGGDPLGSFYGTKLRRANVNFLSAPIKDGTTGTVIVLTTPDAQRTMLAYQGTSSVVNYDSCLASLIAKTNVFVVEGYLFELPDTIRTITKACEEAHRNGALVAVTASDVSCIERHYDDFWDIVGNYADIVFANSDEARAFCHFSAEESPISATRYMSHFVPFVSVTDGINGSYIGVKGEAIYIPPSPCVPVDTCGAGDAYASGILYGILRGVSDLKGMGDMAATIAATVVGQQGTRLRVQDAVELARSHAFRLNGSGVRTDVGS

SEQ ID NO: 26536 - protein, 680 aa, Arabidopsis thaliana
LKMFVPITLLAFGVLVPVNWTGETLENIDDLTFSNVDKLSISNVPPGSPRFWAHITMTYVITFWTCYILYMEYKAVANMRLRHLAAESRRPDQLTVLVRNVPPDPDESVNEHVEHFFCVNHPDHYLCHQVVYNANDLAKLVAQRKAMQNWLTYYENKFERKPSSRPTTKTGYGGFWGTTVDAIDFYTSKMDILAEQEAVEREKIMNDPKAIMPAAFVSFRSRWGTAVCAQTQQCHNPTIWLTEWAPEPRDVFWDNLAIPYVELSIRRLLTTVALFFLIFCFMIPIAFVQSLANLEGIQKVLPFLKPVIEMKTVKSVIQGFLPGIALKIFLIILPTILMTMSQIEGYTSLSYLDRRSAEKYFWFIIVNVFLGSIITGTAFQQLKSFLEQPPTEIPKTVGVSIPMKATFFITYIMVDGWAGIAAEILRVVPLVIFHLKNTFLVKTEQDRQQAMDPGHLDFATSEPRIQFYFLLGLVYAAVAPILLPFIIVFFAFAYVVFRHQVINVYDQKYESGARYWPDVHRRLIICLIISQLLMMGLLSTKKFAKVTALLLPQPILTFWFYRYCAGRFESAFSKFPLQEAMVKDTLEKATEPNLNLKEYLKDAYVHPVFKGNDFDRPRVVDEEESNPLVRTKRTSQGTTRYNSEASSSATTTPVANNDSPRCWGTKIGSFGCVIVVSYSC

SEQ ID NO: 26537 - protein, 422 aa, Arabidopsis thaliana
MEARPVHRSGSRDLTRTSSIPSTQKPSPVEDSFMRSDNNSQLMSRPLGQTYHLLSSSNGGAVGHICSSSSSGFATNLHYSTMVSHEKQQHYTGSSSNNAVQTPSNNDSAWCHDSLPGGFLDFHETNPAIQNNCQIEDGGIAAAFDDIQKRSDWHEWADHLITDDDPLMSTNWNDLLLETNSNSDSKDQKTLQIPQPQIVQQQPSPSVELRPVSTTSSNSNNGTGKARMRWTPELHEAFVEAVNSLGGSERATPKGVLKIMKVEGLTIYHVKSHLQKYRTARYRPEPSETEFNVKTKVSLITTGSPERKLTPLEHITSLDLKGGIGITEALRLQMEVQKQLHEQLEIQRNLQLRIEEQGKYLQMMFEKQNSGLTKGTASTSDSAAKSEQEDKKTADSKEVPEEETRKCEELESPQPKRPKIDN

SEQ ID NO: 26538 - protein, 508 aa, Arabidopsis thaliana
MEVPSETTNLADLRRPLVVPVVSERKPPADVGLGLESVLTERSLPYRRRVYLGACIEMKLLFRLALPAILVYLVNSGMGISARIFAGHLGKNELAAASIGNSCFSLVYGLMLGMGSAVETLCGQAYGAHRYEMLGIYLQRATIVLALVGLPMTLLYTFSYPILILLGEPKTVSYMGSKYIAGLIPQIFAYAVNFTAQKFLQAQSVVAPSAFISAAALILQILLTWITVYVMDMGFMGIAYVLTISWWVIVGSQCFYIAVSPKFRHTWTGLSWRSLQGLWSFFKLSAGSAVMICLEMWYSQILVLLAGLLENPARSLDSLSICMSISALSFMVSVGFNAAVSVRTSNELGAGNPKSAWFSTWTATFVSFVISVTEALAVIWFRDYVSYIFTEDADVAKAVSDLCPFLAITIILNGIQPVLSGISSFRFKLENLTGVAVGCGWQTYVAYVNVGCYYVVGIPVGCILGFTFDFQAKGIWTGMIGGGKSEETFGSVGRQEGASPKLVMDFTE

SEQ ID NO: 26539 - protein, 457 aa, Arabidopsis thaliana
MLDSLVSKLPSLSTSDHASVVALNLFVALLCACIVLGHLLEENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAAVSPLFSSLPFFLTGLISAYVIKKLYFGRWPHINCHRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVRNLWMIK

SEQ ID NO: 26540 - protein, 400 aa, Arabidopsis thaliana
MGLRMSESAKPYFAMVCLQFGYAGMNLVTKTVLDRGMSHYVLVAYRNAFATAAIAPFALLSERKVRSKMTFPIFMRIFLLALLGPVIDQNLYYIGLKLTSPTFSSAVSNIVPAITIILATLFRMEKVEMRKVRCLVKVMGTLVTVVGSILMIFYKGPFINFFRSHLTAASSPPTADYLKAAVFLLLASLSWASFFVLQAATLKKYSAHLSMSTMVCFMGTLQSLALAFVMEHNPSALNIGFDMNLLASAYAGIMSSSIAYYVQGLMMQRKGPVFVTAFNPLIVVIVSIMSFFVLGQGIYLGGYVNNNRVIGVVVLMVGVYAVLWGKHVDDDGEETRHEDNVVAVKCCSGNNGLTIMPKIDEADEEDVETGKATSEKESSVPEVVVVVFCSENVHSVSRPN

SEQ ID NO: 26541 - protein, 507 aa, Arabidopsis thaliana
MESSPDPGELIKSSQPSFFEFQKQASLMTSCNLLWKELSEHFTSMEQNLMKKSEALRQMIETLDNQTQSSIELLKHREVTIDHSVEIAEGKVEERVRAALDSLEKARDCGDEDTGEVDDGDGLLSALKSLCLKMDARGFWGFVIARKKELENLRSQIPVALVDCVDPPKLVLEAVSEVFPVDKRGGGEKVSNDFGWACVVILESLIPVMVDPVMGKSRLLVTPSVKEKAKEIAETWKASLEERGGIENVKTPDVHTFLQHLVTFGIVKKDDLALYRKLVVGSAWRKQMPKLAVSVGLGDQMPDMIEELIIRGQQLDAVHFTFEVGLVHLFPPVPLLKAYLRDAKKATALITDDSNNSGRSAGSVSSALAYQCMCLEKTKTEKRKPAVIPANKRTRASYSGPMPPAKAGRITNAYVSSFPPPPPTFIRSQSHSPQYGVPAYTTSPPTIYSNRSPPYQYSPEAVHGSYQTSPVSYPTAYGTYCSPVAAPPPPVYHPHPHHHHHIQHAYY

SEQ ID NO: 26542 - protein, 587 aa, Arabidopsis thaliana
MQVQKNLPRKKRRKLEAAREMLEDNEGEEEEEDEEGDEKRGRSRGKDKKKQETDKKGLTLKDLGYMRAKAVKAKQRAIDSGKMERPKPDKKQSRSKPRNQPRGEEMKDLFKSDMGEKKQGRGGAAAAAKPRTKSKNSFKSKARSHIIFVGKKRGGEKRDDNTLHKSLEKRLRIVDVSPTKSNPSVRLPNGFQLICPLLFFLFSSCFFCVEKMMKRETLIEAGIIGGLAGAQVIYAGNSELLSQLLSLGIDPLLIVILCTFASVLLITPLAFLLERKLWPRSLSFKLKIKLVLVALAGVTLFQGLFLEGMKHTSASMATAMPNLCPAFIFVIAWAAGMEKVKLSCMYSRVKMGGTVLCVMGALIMSLMHSTTATLSSVKTIPIVPDEVVVDKDKILGCLYLLLAICGLSSSIVLQASILAEFPAPISMFSMVSLMGGITTVALQYALKGSMEMGSASVIGLGHLVGYAILGGLVSGGGLSFNAWVIKRKGPVIVSLFSPIATVVCVVVSAFTMEESFNLGRKRSHLSSFLFVFLCQISFAGMALMFGGLYFVLWAKGKEDCEEIDEMKQDDEESLLRTEFDLQKPLLL

SEQ ID NO: 26543 - protein, 548 aa, Arabidopsis thaliana
MEAALAACALPSLRILNTKPRFRCSFSNPSLPISPNSLITRKSSRFTTAVSSPPSSSAATSTNSPPEPEALFEPGSDKFDWYANWYPVMPICDLDKKVPHGKKVMGIDLVVWWDRNEKQWKVMDDTCPHRLAPLSDGRIDQWGRLQCVYHGWCFNGSGDCKLIPQAPPDGPPHMVYMEHKVKVFGCINDYFGNANQVHTFKQACVAVYPSTVQHEIIWFWPNSDPKYKNIIETNKPPYIPELEDPSFTKLMGNRDIPYGYLLAFTSFQLCVILLAEKIDREGGKPLEINVKKLDNKGFFSKQEWGYSNFIAPCVYRSSTDPLPEQEHEYPAPAASDKAALSKRRLSLIFICIPVSPGRSRLIWTFPRNFGVFIDKIVPRWVFHIGQNTILDSDLHLLHVEERKILERGPENWQKACFIPTKSDANVVTFRRWFNKYSEARVDWRGKFDPFLLPPTPPREQLFDRYWSHVENCSSCKKAHKYLNALEVILQIASVAMIGVMAVLKQTTMSNVARIAVLVAAVLSFAASKWLSHFIYKTFHYHDYNHAVV

SEQ ID NO: 26544 - protein, 1070 aa, Arabidopsis thaliana
MPHRDHIAWASVLTALNQANLSGKTLSVFSSVGSSSGLRPDDFVFSALVKACANLGSIDHGRQVHCHFIVSEYANDEVVKSSLVDMYAKCGLLNSAKAVFDSIRVKNTISWTAMVSGYAKSGRKEEALELFRILPVKNLYSWTALISGFVQSGKGLEAFSVFTEMRRERVDILDPLVLSSIVGACANLAASIAGRQVHGNALIDMYAKCSDVIAAKDIFSRMRHRDVVSWTSLIVGMAQHGQAEKALALYDDMVSHGVKPNEVTFVGLIYACSHVGFVEKGRELFQSMTKDYGIRPSLQHYTCLLDLLGRSGLLDEAENLIHTMPFPPDEPTWAALLSACKRQGRGQMGIRIADHLVSSFKLKDPSTYILLSNIYASASLWGKVSEARRKLGEMEVRKDPGHSSVEVRKETEVFYAGETSHPLKEDIFRLLKKLEEEMRIRNGYVPDTSWILHDMDEQEKEKLLFWHSERSAVAYGLLKAVPGTPIRIVKNLRVCGDCHVVLKHISEITEREIIVRDATRYHHFKGGKCSCNDFCNYGHAKSIFILNKETIKWRRVASLIPHTQREMATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQIIDLGNTGLLPLEIRFLHDPSKDTGYVGSALSSNMIRFFKNSDDTWSHEASEVVISVKPLKVENWILPEMPGLITDFLISLDDRFFYFVNWLHGDIRQYNIEDPKNPVLTGQIWVGGLLQKGSPYKAVGEDGNTYQFDVPQIKVCNQNIIFWSVLTKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 26545 - protein, 227 aa, Arabidopsis thaliana
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGCFYRRRRFNGTIILMSREMMTCPYGAIKIRFLFPFLVL

SEQ ID NO: 26546 - protein, 501 aa, Arabidopsis thaliana
MPNSSSVVLMNVLKLIDQYDLYGQVAYPKHHKQSEVPDIYRLAAKTKGVFINPALVEPFGLTLIEAAAYGLPIVATRNGGPVDIVKALNNGLLVDPHDQQAISDALLKLVANKHLWAECRKNGLKNIHRFSWPEHCRNYLSHVEHCRNRHPTSSLDIMKVPEELTSDSLRDVDDISLRFSTEGDFTLNGELDAGTRQKKLVDAISQMNSMKGCSAAIYSPGRRQMLFVVAVDSYDDNGNIKANLNEIIKNMIKAADLTSGKGKIGFVLASGSSLQEVVDITQKNLINLEDFDAIVCNSGSEIYYPWRDMMVDADYETHVEYKWPGESIRSVILRLICTEPAAEDDITEYASSCSTRCYAISVKQGVKTRRVDDLRQRLRMRGLRCNIVYTHAATRLNVIPLCASRIQALRYLSIRWGIDMSKTVFFLGEKGDTDYEDLLGGLHKTIILKGVVGSDSEKLLRSEENFKREDAVPQESPNISYVKENGGSQEIMSTLEAYGIK

SEQ ID NO: 26547 - protein, 314 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWNPFLEWNLHYVCKTEKRVKTKQISSVKKVYLSTLPENSTHGGVRRVFRPKRRLEEMKMKRRGQKIEMVVEQKKSKEDEDALSLSQGGEEEKRYEEEPYFC

SEQ ID NO: 26548 - protein, 366 aa, Brassica napus
MFKQESNNIGSEENNTGPRACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 26549 - protein, 368 aa, Brassica napus
MFKQESNNNICNRENNRGARACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 26550 - protein, 374 aa, Brassica napus
MGKSEEPKVTKSDNKPSSPPADQTNVHVYPDWAAMQAYYGPRVAIPPYYNSAMAAASGHPPPPYMWNPQHMMSPYGTPYAAVYPHGGGVYAHPGFPMPQSQKGAALSTPGTPLNIDTPSKSTGNTENGLMKKLKEFDGLAMSLGNGNNGDEGKRSRNSSETDGSSDGSDGNTTGADEPKLKRRREGTPTKDEEKHLVQSSSFRSVSQSSGDNVVKHSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 26551 - protein, 376 aa, Brassica napus
MGKSEEPKVTKSDNKPSSPPADQTNVHVYPDWAAMQAYYGPRVAMPPYYNSAMAAASGHPPPPYMWNPQHMMSPYGTPYAAVYPHGGGVYAHPGFPMPQGQKGATPLTTPGTPLNIDTPSKSTGNTENGLMKKLKEFDGLAMSLGNGNNGDEGKRSRNSSETDGSSDGSDGNTTGADEPKLKRSREGTPAKDEKKHLVQSSSFRSVSQSSGDNNCVKPSVQGGGGAIVSAAGVSANSNPTFMSQSLAMVPPETWLQNERELKRERRKQSNRESARRSRLRKQAETEELARKVEALTAENMALRSELNQLNEKSNNLRGANATLLDKLKSSEPEKRVKSSGNGDDKNKKQGDNETNSTSKLHQLLDTKPRADGVAAR

SEQ ID NO: 26552 - protein, 352 aa, Brassica napus
MGSNEEGKTTQSDKPAQVQAPPPPPEQSNVHVYHHDWAAMQAYYGPRVAITPQYYNSNGHAAPPPPYIWGSPSPMMAPYGTPYPPFCPPGGVYAHPALQMGSQPQGPASQATPVVATPLNLEAHPANSSGNTDQGFMTKLKEFDGLAMSISNNKSGSGEHSSEPKNSQSSENDDSSNGSDGNTTGGEQSRKKRSREGSPNNDGKPSSQIVPLLRDESEKHAVTMGTPVMPTAMDFPQPFPGAPHEVWNEKEVKREKRKQSNRESARRSRLRKQAETEELSVKVDALVAENMTLRSKLGQLNDESEKLRLENQALLDQLKAQATGKTENLISGVDKNNSVSGTVVVRMRNSNS

SEQ ID NO: 26553 - protein, 661 aa, Brassica napus
MATDSAMFASSRRRQSPSLEAFLSPVDLSDVPLLQTLSSISSEIVSCFSNARFSFQRRNTRSLIRKVQVFAVLLQHLAPESSLDPTAVLCFKELYLLLHHSKFLLRYCAHSSKLWLLLQSPSLSSFFHDLSKDYSTLLDVFLPVDSLCLNDDVREQVQLLHMQHYVDDNNDETLRNRLYSFLDEFENGSVPNSEELRFFFFEKLAIKDPTSYREEIEFLEEQIKSHGCDLDPTRSVINGFIDITRYVMFLLFKIEDGNEIKKQRKRLISEEIENTFTTTLPKDFICSISLNLMNDPVIISTGQTYDRTSIARWIHQEGRSTCPKTGQKLVDLSFVSNLALRHLTTLWCEVTGLSHDSPKESLPKVFQTRASTEANKATLSILVQNLAHGSELAAGEIRVLTRTVTETRTLIVETGAIPYLRSLLKSQNAVAQENAVASIFNLSIDEANRSLIVEEHDCLEPIMSVLVSGLTMRAKEIAAATLYTLSSVHDYKKAIANADGCIEALALVLRNGTVRGKKDAVYALHSLWLHPDNCSLMVKRGGVSALVGALGEEAVAEKVAWVLGVMATESLGAESIGREETVVTGLMELMRCGRPRGKEKAIATLLQLCTAGGAVVTEKVVKTPALAVLTRKLLLTGTDRAKRKAVSLSKVCKGCDQNTQR

SEQ ID NO: 26554 - protein, 56 aa, Brassica napus
DWLVEVSEEYKLASDTLYLAVNLIDRFLSNNYIEKRRLQLLGVTCMLIASKYEEIY

SEQ ID NO: 26555 - protein, 260 aa, Brassica napus
MAMLGLVLCLLTILADFTTISEARIPGVYSGGGWETAHATFYGGSDASGTMGSACGYGNLYTKGYGVNTAALSTALFNNGFSCGACFELKCASDPKWCHSGSPSIFVTATNFCPPNFAQPSDNGGWCNPPRPHFDLAMPMFLKIAEYRAGIVPVSFRRVPCRKRGGMRFTINGFRYFNLVLVTNVAGAGNIVRLSVKGTRTSWISMSRNWGQNWQSNSVLVGQALSFRVTASDRRSSTSWNIAPTHWQFGQTFMGKNFRV

SEQ ID NO: 26556 - protein, 613 aa, Brassica oleracea
MEPCDCFETNANQDDLLVKYQYISDALIALAYFSIPLELIYFVNKSAFFPYKWVLMQFGAFIILCGATHFINLWMFFNHSKVVAIVMTLAKVSCAAVSCATALMLVHIIPDLLSVKNRELFLKKKADELDREMGLILTQEETGRHVRMLTHEIRSTLDRHTILRTTLVELGKTLCLEECALWMPSQSGLYLQLSHTLSHKIQVGSSVPINLPIINQLFNSAQAMHIPHTCPLAKIGPPVGRYAPPEVVSVRVPLLHLSNFQGSDWSDLSGKGYAIMVLILPTDGARKWRDHELELVEVVADQVAVALSHAAILEESMHARDQLMEQNFALDKARQEAEMAVHARNDFLAVMNHEMRTPMHAIISLSSLLLETELSPEQRVMIETILKSSNLVATLISDVLDLSRLEDGSLLLENEPFSLQAIFEEVISLIKPIASVKKLSTNLILSADLPAYAIGDEKRLMQTILNIMGNAVKFTKEGHVSIIASIMKPESLRELPSPDFYPVPSDNHFYLCVQVKDTGCGIHTQDIPFLFTKFVQPRTGAQRNHSGAGLGLALCKRFVGLMGGCIWIESEGIEKGCTASFIIRLGICNGPGSSSGSMALRLAAKSQTRPWNW

SEQ ID NO: 26557 - protein, 150 aa, Brassica oleracea var. botrytis
MGRGRVEMKRIENKINRQVTFSKRRAGLLKKAHEISILCDAEVSLIVFSHKGKLFEYSSESCMEKVLERYERYSYAEKQLKAPDSHVNAQTNWSMEYSRLKAKIELWERNQRHYLGEDLESISIKELQNLEQQLDTSLKHIRSRKNQLMH

SEQ ID NO: 26558 - protein, 307 aa, Raphanus sativus
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 26559 - protein, 358 aa, Raphanus sativus
QSDKPEQVQAPPPPPEQSNVHVYHHDWAAMQAYYGPRVAIPPQYYNSNGHAPAPPPPYIWGSPSPMMAPYGTPYPPFCPPGGVYAHPGLQMGSQPQGPVSQATPVVTTTPLNLEAPANSPGNTDQGFMKKLIEFDGLAMSISNNKAGSAEHSSGPRNSQSSENDDSSNGSDGNTTGGEQSRKKRSREGSPNDDGKPSSQIVPLLRDENEKPAVTMGTPVMPTAMDFPQPCHGAPHEVWNEKEVKREKRKQSNRESARRSRLRKQAETEELSLKVDALVAENMTLRSKLAQLNDESEKLRLENEASLAQLKATQTQAAGKTENLISRVDNNNNSVSGSSKNVEQQLLNVSLRTDSVAAS

SEQ ID NO: 26560 - protein, 110 aa, Sinapis alba
MSGVWVFKNGVIRLVENPNQSGGDTNSRRKVMVYLPTGEVISSYSTLEQILRSLGWERYFGGGDTDLLQFHKRSSIDLISLPKDFTKFSSVYMYDIVVKNPNYFHVRDSN

SEQ ID NO: 26561 - protein, 372 aa, Sinapis alba
MGSSHEEGKSTTQSDKPAQVQAPPPPPPPIQEQSNVHVYHHDWAAMQAYYGTRVAIPPQYYNSNGHAAPPPPYIWGSPSPMMAPYGTPYPPFCPPGGIYAHPGVQMGTQPQGPTSQATPVVTTPLNLEAPANSAGNTDQGFMKKLKEFDGLAMSISNNKAGSAEHSSEPRNSQSSENNDDSSNGSDGNTTGGEQSRKKRSREGSPTNDGKPSSQIVPLLRDENEKQAVTMGTPVMPTAMDFPQPCHGAPREVWNEKEVKREKRKQSNRESARRSRLRKQAETEELSVKVDALVAENMTLRSKLGQLNDESEKLRLENEALLAQLKATQTQATGKTENLISGVDKNNSVSGSSKNVEQQLLNVSLRTDSVAAS

SEQ ID NO: 26562 - protein, 481 aa, Sinapis alba
MATTAVIGLNAGKRLLSSSFYYSDVTEKFLSVNDLCSSQYHTRSGITAKKTSSSSSSNYSPSFPSSSRQTQSAKALKESVASSVQPWLPPGSDQELEEDDIDHSVEALLLLQRSMLEKQWNLSFEKTRKKVPVTCSGISARQRRIGAKKKTNVKAVSEVNFQNNLVKGYVKGVISDHVLSHAEVVRLSKKIKSGLRLDEHKSRLTDRLGCEPSDEQLAMSLKISRAELQAWLMECHLAREKLAMSNVRLVMSIAQRYDNMGAEMSDLVQGGLIGLLRGIEKFDSSKGFRISTYVYWWIRQGVSRALVDNSRTLRLPTHLHERLGLIRNAKLRLQEKGITPSIDRIAESLNMSQKKVRNATEAVSKIFSLDRDAFPSLNGLPGETHHSYIADNRLENNPWHGYDALALKDEVSKLISVTLGEREREIIRLYYGLDKECLTWEDISQRIGLSRERVRQVGLVALEKLKHAARKRKMEAMILKN

SEQ ID NO: 26563 - protein, 446 aa, Malus x domestica
MAPTRNTFRVGPTTCSTGTACFTPLGSPEAARCSAADMSRPTSTPLSVTPATLYFPTSSLASTASPLPPHVALSAARVLTGQYNPANGIGLANTSLAFFGDRLYALGESDLPYSLRLTSNGDIETLGRHDFDGKLSMNMTAHPKIDPDTGEAFAFRYGFIRPFLTYFRFDSNGVKQPDVPIFSMVTPTFLHDFAITKKHAIFADIQIGLNLIDMITKRATPFGLDPSKVPRIGVIPLYAKDESEMRWFEVPGFNGVHATNAWDEDDAIVMVAPNVLSAEHVLERVDLVHCLVEKVRIDLKTGIVTRQPISTRNLDFAVINPAYLGRKNKYVYAAEGDPMPKISGVVKLDVSNVEHKECIVASRMFGPGCYGGEPFFVAREPENPEADEDNGFLVSYVHDEKAGESRFLVMDAKSPQLDIVAAVRMPRRVPYGFHGLFVRESDLNNL

SEQ ID NO: 26564 - protein, 246 aa, Malus x domestica
MGRGRVELKRIENKINRQVTFAKRRNGLLKKAYELSVLCDAEVALIIFSNRGKLYEFCSSSSMLKTLDRYQKCSYGAVDQVNRPAKELESSYREYMKLKGRYESLQRTQRNLLGEDLGPLNTKELEQLERQLEGSLKQVRSTKTQYMLDQLSDLQNKEQLLIEANRDLTMKLDEISSRNQLRQSWEGGDQGMAYATQHHHAQSQGFFQPLDCNPTLQMGYSAVGSEQMSATTNAQQVNCFIPGWML

SEQ ID NO: 26565 - protein, 121 aa, Malus x domestica
VPLLCTSIGLWAGLVIEYTTEHYTSNAYSPVQDVADSCRTGAATNVIFGLALGYKSVIIPVFAIAFAIYVSFSLAAMSGIAVAALGMLSTISTGLAIDAYGPISDNAGGIAEMAGMNHERV

SEQ ID NO: 26566 - protein, 423 aa, Glycine max
GNSEEEKSVKTGSPSSSPATTEQTNQPNIHVYPDWAAMQYYGPRVNIPPYFNSAVASGHAPHPYMWGPPQPMMQPYGPPYAAFYSHGGVYTHPAVAIGPHSHGQGVPSSPAAGTPSSVESPTKFSGNTNQGLVKKLKGFDELAMSIGNCNAESAERGAENRLSQSVDTEGSSDGSDGNTAGANQTKRKRSREGTPITDAEGKTELQNGPASKETASSKKIVSATPASVAGTLVGPVVSSGMATALELRNPSTVHSKANSTSAAQPCAVVRNETWLQNERELKRERRKQSNRESARRSRLRKQAETEELARKVEMLTAENVSLKSEITRLTEGSEQMRMENSALREKLINTQLGPREEITLSSIDSKRAAPVSTENLLSRVNNSGANDRPAENENDICETKPNSGAKLHQLLDTNPRANAVAAG

SEQ ID NO: 26567 - protein, 240 aa, Medicago sativa
RGKIQIKRIENTTNRQVIFSKRRNGLLKKAKELAILCDAEVGVMIFSSTAKLYDFASTSLRSVIGRYNKSKEEHNQLGSTASEIKFGQREAAVLRQQLHNLQESHRQIMGEELSGLTVKELQGLENQLEISLRGVRMKKEQLFMDEIQELNRKGDIIHQENVELYRKVYGTKDKNGTNRVLSLTNGVGIGDDSNRTCESPAQPATETRTTTALMHSLEISVLTCKQGKWTQILISYMNGI

SEQ ID NO: 26568 - protein, 51 aa, Phaseolus vulgaris
MKQFRVLTCQTVADMIKGKTPEEIRKTFNIKNDFTPEEEEEVRRENQWAFE

SEQ ID NO: 26569 - protein, 424 aa, Phaseolus vulgaris
MGNSEEGKSVKTGSPSSPATTTNQTNQPNFHVYPDWAAMQYYGPRVNIPPYFNSAVASGHAPHPYMWGPPQPMMPPYGPPYAAFYSPGGVYTHPAVAIGPHSHGQGVPSPPAAGTPSSVDSPTKLSGNTDQGLMKKLKGFDGLAMSIGNCNAESAELGAENRLSQSVDTEGSSDGSDGNTAGANQTKMKRSREETSTTDGEGKTETQDGPVSKETTSSKMVMSATPASVAGKLVGPVISSGMTTALELRKPLTVHSKENPTSAPQPCAAVPPEAWLQNERELKRERRKQSNRESARRSRLRKQAETEELARKVEMLTAENVSLKSEITQLTEGSEQMRMENSALREKLRNTQLGQREEIILDSIDSKRSTPVSTENLLSRVNNSSSNDRSAENESDFCENKPNSGAKLHQLLDTNPRADAVAAG

SEQ ID NO: 26570 - protein, 635 aa, Pisum sativum
MMESCECIDTPYPPDELLVKYQYISDVLIALAYFSIPVELIYFVQKSAFFPYRWVLMQFGAFIVLCGATHFINLWTFSAHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRSGLNLQLSHTLTYHVQVGSTVPTNLPIVNEVFNSPRATRIPHTCPLARIRPLVGRYVPPEVVAVRVPLLHLSNFQINDWPDLSAKSFAIMVLILPTDSARKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLAALINDVLDLSRLEDGSLELEMGKINLHGVLEEVIELIKPIASVKKLPITLILAPDLPDNAIGDVKRLMQTLLNVVGNAVKYTKEGYVSIRASVAKPESLQDWRPPEFYPASSDGHFYIRVQVKDSGCGILPQDIPHLFTKFTQSQSGAGRSSSGSGLGLAICKRFVNLMGGHIWMESEGPDKGSTATFVVKLGICGNPDSSDHQATTRGQAYSGSGGLARFKHLVNDGDIGFSNRRNQRSF

SEQ ID NO: 26571 - protein, 401 aa, Pisum sativum
MISSLRQPSISISGSDVVLRKRHATLIQLRPQSFSPFSSREKSQRSVVSTKKPLHLACLGVGNFGSVKNFESEASFGQSDLVKCGAYEADRSEVEGGDGTPSEAAKKVKIGIYFATWWALNVVFNIYNKKVLNAYPYPWLTSTLSLACGSLMMLISWATRIAEAPKTDLEFWKTLFPVAVAHTIGHVAATVSMSKVAVSFTHIIKSGEPAFSVLVSRFILGETFPVPVYLSLLPIIGGCALAAVTELNFNMIGFMGAMISNLAFVFRNIFSKKGMKGKSVSGMNYYACLSILSLAILTPFAIAVEGPAMWAAGWQTALSEIGPQFIWWVAAQSIFYHLYNQVSYMSLDEISPLTFSIGNTMKRISVIVSSIIIFHTPIQPVNALGAAIAVFGTFLYSQAKQ

SEQ ID NO: 26572 - protein, 95 aa, Pisum sativum
MEGLHETGPPPFLTKTFDVVEDPSTDGIVSWSRARNSFVVWDLSKFSTAILPRYFKHSNFSSFVRQLNTYGFRKVDPDRWEFANEGFLAGQRILL

SEQ ID NO: 26573 - protein, 272 aa, Pisum sativum
FVRQLNTYGFRKVDPDRWEFANEGFLAGQRILLRTIKRRRNVAQSPSMQRESGGACIELGEFGLEGEIERLRRDRSVLVAEIVKLRQQQNNSRDQISAMEARLLITEKKHQQMMAFLARALSNQSFIQQLANNKELKGVEMKRKRRLPASSSLENLQNDSVTMMTVPIESVVDYSSREQQEGLTAIESEIETLLSAYDNESRSEIKDPSANESNLSDWEELLNQKLVGGNPEDEVLIGDFSQIDAPVEDLVEKNDDWTVDLQNLVDEMDFEP

SEQ ID NO: 26574 - protein, 347 aa, Pisum sativum
MDGREAMAFSGGPGSYYLHRGGVEAAGSGSGGFQVPPGFRALPNNGIIAQPNVRAQGGNGDTSSMFSLEPQSHADFNHDISVGASSGAPSSEPVKKKRGRPRKYGPDGSVSLKLTPMSAPANSTQDSGTPSEKRGRGRPRGSGRKQQLAALGDWMTSSAGLAFSPHVITIAAGEDIAAKLLLLSQQRPRALCILSGTGIASKVTLRQPASTNAGVTYEGKFQILSLSGSYLVSEDGGPTNRTGGISVSLSSRDGHVIGGSVAMLIAGSPIQLVVCSFVYGGGSKVKTKQGMITNGESSEPHNDNLGSPASAPPDQNYISSPTGMWPGSQPSDMKSAPAHTGIDLTRG

SEQ ID NO: 26575 - protein, 479 aa, Pisum sativum
MEEPTFLFPPPDSDLDLSFTSTTTDRTFTSSSARTSLARTSSLALSFNDRLSTASAAAGDTVSSAIIRRPHRSSDPNWTAIKAATNLSSDGRLHLRHLKLLRHLGSGDLGRVFLCRLRDYDGANFALKVVDKDLLTLKKSTHAETEAEILHALDHPFLPTLYARIDVSHYTCLLIDYCPGGDLHSLLRKQPGNRFTLSAARFFAAEILVALEYLHALGVVYRDLKPENVLIREDGHVMLSDFDLCYKADVSPTFEFSTNHKLHVDPTHGCFSYNRSKSRESVTAEFVAEPTTAFSRSCVGTHEYLAPELVSGNGHGNGVDWWAFGVFIYELLYGTTPFKGCNKESTLRNIASNKDVKFHVAENEEVGMVGARDLIEKLLVKDPRRRLGCARGATDIKRHPFFDGIKWPLIRTYKAPEVKGLLRRKKSESSLSQLSSKRKRGWWKRLGCVLRNKGARFDLLSNYSNNNHYYCYVNNSKVR

SEQ ID NO: 26576 - protein, 553 aa, Pisum sativum
MALALASANSFLLPTKTHFALHVSPPPSKKTLLCTNPSSNFSFNKALSSRRRKQAWCVAAAADVKDATLLDGEEDQKVLVGPSSEQERKGEREVADYDWTEEWYPLYLTKNVPHDAPLGLKVYDKNIVLFRDGNDQFQCYEDRCPHRLAKLSEGQLIDGRLECLYHGWQFEGEGKCVKIPQLPADAKIPKSACVKTYEVRDSQGVLWVWMSRKTPPNVSKIPWFENFARPGFQDISTTHELPYDHSILLENLMDPAHVPISHDRTDWSAKREDAQALGFEVTERTDRGFAGWWGREKDGSKPNFLRFEAPCVLQNNREIVDKNGEINHFSGLFLCRPTGQGKSMLIVRFGATKRSPLIKLFPEWYFHQNASKVFEQDMGFLSSQNEILLKEKVPTKELYLNLKSSDTWVAEYRKWMDKVGHGMPYHFGHSTISLPEEPAVVEHAPAGLVAGLSASSPAKGGIGTMHAPNLANRYFRHVIHCKGCSSAIKAFQIWKNVLSGVVVALAALAILVSGRQWKVLLLASASLCSVGVYACSTAIAMNTTNFIRVHRRL

SEQ ID NO: 26577 - protein, 395 aa, Pisum sativum
MDPDAFTASLFKWDPRTVLSTAPSPRPQLLDYAVTPTTAPMTYHPARLPRELGGLEELFQAYGIRYYTAAKIAELGFTVSTLVDMKDDELDDMMNSLSQIFRWDLLVGERYGIKAAIRAERRRLDEEEIKRRGLLSGDTTNALDALSQEGLSEEPVVQREKEAMGSGGGSTWEVAVVEERRKRQQIRRRRMKMKGNDHGENEEGEEEEEDNISGGGVGGGERQREHPFIVTEPGEVARGKKNGLDYLFHLYEQCREFLIQVQAIAKERGEKCPTKVTNQVFRYAKKAGASYINKPKMRHYVHCYALHCLDEEVSNELRRGFKERGENVGAWRQACYKPLVAIAARQGWDIDAIFNAHPRLSIWYVPTKLRQLCHAERNGAAASSSVSVGTTHLPF

SEQ ID NO: 26578 - protein, 181 aa, Vicia faba
VAYKNVIGSLRAAWRIVSSIEQKEEGRKNDDHVVLVKDYRSKVEAELSNVCASILELLDKNLIPSGSSSESKVFYYKMKGDYHRYLAEFKIGEERKSAAEDTMLSYKAAQDIAAADLPSTHPIRLGLALNFSVFYYEILNQSDKACAMAKQAFEEAIAELDTLGEESYKDSTLIMQLFRDN

SEQ ID NO: 26579 - protein, 257 aa, Vicia faba
MVTGKNNELSKTPGASANGIHSKSGESASEGSSEGSDENSHNVLQDSQLKSGERQDSFEDEPSQNGSSAQAPQNGGLNTPHTVVNQTMSVVPMSVAGPIAAVAGPTTNLNIGMDYWGTPASSTIPAMHGKVPSTAVAGGMVNAGPRDGVHSQPWLQDERELKRQRRKQSNRESARRSRLRKQAECDELAQRADVLSEENASLRAELSRIKSEHAKALAENAALKVKQGEILRNEEIVPGQNDQLVEHVGGGETKQSG

SEQ ID NO: 26580 - protein, 523 aa, Vicia faba
MEPLSSTKQINNNNNLAKPSSLHVETQPLEPSPLRKIMVVASIAAGVQFGWALQLSLLTPYVQLLGIHHTWAAYIWLCGPISGMLVQPIVGYHSDRCTSRFGRRRPFIAAGSIAVAIAVFLIGYAADLGHSFGDSLDQKVRPRAIGIFVVGFWILDVANNMLQGPCRALLGDLCAGNQRKTRNANAFFSFFMAVGNVLGYAAGAYSKLYHVFPFTKTKACNVYCANLKSCFFLSIALLTVLATSALIYVKETALTPEKTVVTTEDGGSSGGMPCFGQLSGAFKELKRPMWILLLVTCLNWIAWFPFLLFDTDWMGKEVYGGTVGEGHAYDMGVREGALGLMLNSVVLGATSLGVDILARGVGGVKRLWGIVNFLLAICLGLTVLVTKLAQHSRQYAPGTGALGDPLPPSEGIKAGALTLFSVLGVPLAITYSIPFALASIFSSTSGAGQGLSLGVLNLAIVIPQMFVSVLSGPWDALFGGGNLPAFVVGAVAALASGILSIILLPSPPPDMAKSVSATGGGFH

SEQ ID NO: 26581 - protein, 322 aa, Vicia faba
  unsure (1)..(322): unsure at all Xaa locations
MEGLATGSNERNELVRVRHGSDSGSKPVTNLNGQFCQICGDTIGLTAAGGVFVACHECAFPLCHPCYEYEIKNVSQLCPQCKTRYKTHKDGPQVKGDDDEDDVDGLRNEVKYGPGNNSKTGWQWDEDADLSSSSGHDSQLQNPHLTNGQLMSGEIACATSDTQSAQTTSGPLGQSGNVHSRPYADPKQPGLESDEEMRRVPDMGGESAGTSASHKGTGSTAGPERAQGTGEGQKKRGRSPADKESKRLKRLLRNRVSAXQARERKKAYLSDLETRVNDLEKKNSELKEKLSTLQNENQMLRQILKNTTASRRGGNSGTNNAE

SEQ ID NO: 26582 - protein, 280 aa, Vigna unguiculata
PPSPSPPPPYVYKSPPPPSPSPPPPYVYKSPPPPSPSPPPPYVYKSPPPPSPSPPPPYVYKSPPPPSPSPPPPYVYKSPPPPSPSPPPPYVYKSPPPPSPSPPPPYVYKSPPPPSPSPPPPYVYKSPPPPPPYVYKSPPPPSPSPPPPYVYKSPPPPSPSPPPPYVYKSPPPPSPSPPPPYIYKSPPPPSPSPPPPYVYKSPPPPSPSPPPPYVYKSPPPPSPSPPPPYVYKSPPPPSPSPPPPYVYKSPPPPSPSPPPPYVYKSPPPPSPSPPPPYVYG

SEQ ID NO: 26583 - protein, 105 aa, Citrus sinensis
GEGTATQDSNNSGANSNGTATNGGEEDLKSWDTDFVKVDQATLFDLILAANYLNIKGLLDLTCQTVADMIKGKTPEEIRKTFNIKKDFTPEEEEEVRRENQWAFE

SEQ ID NO: 26584 - protein, 433 aa, Daucus carota
ATSLQITLFSLLFIFTITQAQPSFRPSALVVPVKKDASTLQYVTTINQRTPLVSENLVVDLGGRFLWVDCDQNYVSSTYRPVRCRTSQCSLSGSIACGDCFNGPRPGCNNNTCGVFPENPVINTATGGEVAEDVVSVESTDGSSSGRVVTVPRFIFSCAPTSLLQNLASGVVGMAGLGRTRIALPSQFASAFSFKRKFAMCLSGSTSSNSVIIFGNDPYTFLPNIIVSDKTLTYTPLLTNPVSTSATSTQGEPSVEYFIGVKSIKINSKIVALNTSLLSISSAGLGGTKISTINPYTVLETSIYKAVTEAFIKESAARNITRVASVAPFGACFSTDNILSTRLGPSVPSIDLVLQSESVVWTITGSNSMVYINDNVVCLGVVDGGSNLRTSIVIGGHQLEDNLVQFDLATSRVGFSGTLLGSRTTCANFNFTS

SEQ ID NO: 26585 - protein, 117 aa, Daucus carota
LDEAIIDRTEAIEVAKRKEKLLKLQKQHLDELNKEVKGEQLPVESDASDKKPVDTGFIAADSEQAIKDAADITMVGVSRKKRELYKAMQIGNERKKAKTQLLKERKRLLDEAKKSNT

SEQ ID NO: 26586 - protein, 502 aa, Daucus carota
MADIAISGEPNFSDLVPTKKGRSRKALKPKTPSSNETNILPVPVSQASPVKKAMTESTGKENEKKKTKKKAAKEAKPQEGDFEKMFEEMQKKLEQMTLEKAKTEEMLKEREEALRRKEEELETRGREQEKLQIEIKKLGKMKEFKPTVNFPLVQAPKEKELGKKEKKKVCPEKKKPSPPYALWLKDQWTEVKKENPDAEFKEISTMLAAKWKTVTAEEKKPYEEKYQAEKEAYLKIVGAEKRENEAMKLLEEEQKQRTAMELLEQYMQFKEETENDKKKKTKKEKDPLKPKHPVSAFFLFMNERRADLVAEKKNVLEVGKITGEEWKNMTEKEKAPYEEMAKKNKNQYLQQMEVYKKKKDEEAASLQKEEEELSKIQKQEAMQLLKKKEKTENLIKKTKEERQKKQKGEKKIVDPNKPKRPASSFLLFSKEARKTISEERPGINNSTLNALISVKWKEISHEEKQLWNEKAAGAMEAYKKEMEEYNKTTAAEESSSSCSGPQ

SEQ ID NO: 26587 - protein, 501 aa, Daucus carota
MAGPEADRNRHRGGATAAPPPRSRVSLRLLLRVASVACGIQFGWALQLSLLTPYVQELGIPHAWSSIIWLCGPLSGLLVQPIVGHMSDQCTSKYGRRRPFIVAGGTAIILAVIIIAHSADIGGLLGDTADNKTMAIVAFVIGFWILDVANNMTQGPCRALLADLTGNDARRTRVANAYFSLFMAIGNVLGYATGAYSGWYKVFPFSLTSSCTINCANLKSAFYIDIIFIIITTYISISAAKERPRISSQDGPQFSEDGTAQSGHIEEAFLWELFGTFRLLPGSVWVILLVTCLNWIGWFPFILFDTDWMGREIYGGEPNQGQSYSDGVRMGAFGLMMNSVVLGITSVLMEKLCRIWGSGFMWGLSNILMTICFFAMLLITFIAKNMDYGTNPPPNGIVISALIVFAILGIPLAITYSVPYALVSTRIESLGLGQGLSMGVLNLAIVVPQVIVSLGSGPWDQLFGGGNSPAFVVAALSAFAAGLIALIAIRRPRVDKSRLHH

SEQ ID NO: 26588 - protein, 515 aa, Daucus carota
MENGTKELNKPQPPSSAAMQLQTPVQKIPTATWKLVLVAAIAAGVQFGWALQLSLLTPYVQLLGIPHKWAAYIWLCGPISGMLVQPIVGYYSDHCQSSFGRRRPFIASGAGCVAISVILIGFAADISYKAGDDMSKTLKPRAVTVFVIGFWILDVANNMLQGPCRALLADLCSGDTRRMRSANAFYSFFMAVGNILGYAAGSYNNLYKLFPFSKTHACDLYCANLKSCFIISIALLIIITVVALSVVRENSGPPDDADAAEEPPSSGKIPVFGELLGALKDLPRPMLLLLIVTCLNWIAWFPFILFDTDWMGREIYGGTAGQGKLYDQGVRAGALGLLLNSVVLGLTSIAVEYLVRGVGGVKILWGFVNFILAIGLVMTVVVSKVAQHQREHSANGQLLPPSAGVKAGALSLFSILGIPLSITYSIPFALASIYSSGSGAGQGLSLGVLNLAIVVPQMIVSVLAGPFDSLFGGGNLPAFVVGAISAAISGVLAIVLLPKPSKDAASKLSLSGTYH

SEQ ID NO: 26589 - protein, 227 aa, Petroselinum crispum
MIAGKVALIAGYGDVGKGCAAAMKQAGARVIVTEIDPICALQATMEGLQVLPLEDVVSEVDIFVTTTGNKDIIMVSDMRKMKNNAIVDNIGHFDNEIDMLGLETYPGVKRITIKPQTDRWVFPDTGRGIIILAEGRLMNLGCATGHPSFVMSCSFTNQVIAQLELWNEKSSGKYEKKVYVCPKHLDEKVAALHLGKLGAKLTKLSKDQADYISVPVEGPYKPAHYRY

SEQ ID NO: 26590 - protein, 307 aa, Petroselinum crispum
MIQNQKVDNRRMGNHKQKWTAEEEEALKAGVKKHGMGKWKTILVDPDFATALTHRSNIDLKDKWRNLGISSSTAAQVSKDKSPVLSITNGSAAIPIAQTAITAQNAITAQNTVTAQNTVTAQNAATAQKASTTVALVDANAISSSPKTPANAVTIPTKRYYSLIFEAISSAKDPRGADFNTIATFIEQKNEVPHNFRRALSSLVRRLTMQKKLEKVEQRFKIKNSGTRIPTPRQRDAKPGTSRKSVLLDPATLEGAVSIASERLADAEHKSCVAIEAVKESENIAELAEEAESMLEIAKGIWEQCHL

SEQ ID NO: 26591 - protein, 307 aa, Petroselinum crispum
MIQTQKVDNRRMGNHKQKWTAEEEEALKAGVKKHGMGKWKTILVDPDFATALTHRSNIDLKDKWRNLGISSSAAAQVSKDKSPVLSITNGSAAIPIAQTAITAQNAITAQNTVTAQNTVTAQNAATAQKASTTVALVDANAISSSPKTPANAVTIPTKRYYSLIFEAISSAKDPRGADFNTIATFIEQKNEVPHNFRRALSSLVRRLTMQKKLEKVEQRFKIKNSGTRIPTPRQRDAKPGTSRKSVLLDPATLEGAVSIASERLADAEHKSCVAIEAVKESENIAELAEEAESMLEIAKGIWEQCHL

SEQ ID NO: 26592 - protein, 116 aa, Lycopersicon esculentum
  unsure (1)..(116): unsure at all Xaa locations
IRXYRMNSFNQSKITNADHQQEENVNKETESSNKKINHGINNTKNNDVDFVKVNMDGLPIGRKVNLSSHICYETLAKILEEMFFKSTKTTNCGEKEQVTKSCKLLDGSSEFVLTYE

SEQ ID NO: 26593 - protein, 460 aa, Lycopersicon esculentum
MAAKPIDDTIWRGSFMISRPEMRLNLTAHLSSKACAKVWLAAKEMAEVIYPEFLPKRDVWPKSFKSAKLIDDNIAIYFFSVKGRDDQVFENLLYNLRHYDIALRALVGDSELLIFTSAHLPEKHHIAGFEGKVYLWGVFSGRQAPPQESPDDCFIHNTRVTQASIPNSANDGKDRSCKEFSNRKDPSTASKSARKGRPLDDAWQHATPVDGKKQRTVCNYCGFISSSGGITYLKTHLGGGDPTGSLKGCPNVPPEVKRVMKEWLLGTIRGGKAPQLQEIRTDFEVPASKKSVRRGRPLDAAWDYATPVDAKRQRAVCKYCGFISSSGGITHLKAHLAGGDPKGPSKGCPNVPPEVKRAMAESLNRTVKGAKSMQPDEIRRYMKAENDWSPPRSDDYSLNQHRIVKNAQYSHFANGNSVNDMTLSKQSETAHVDSYMEVMSSHNACKSSFLSKPSTRVGFI

SEQ ID NO: 26594 - protein, 519 aa, Lycopersicon esculentum
QGELFLKTRAEELDKEMGLIIRQEETGRHVRMLTHEIRSTLDRHTTLKTTLVELGRTLDLAECALWMPCQGGLTLQLSHNLNNLIPLGSTVPINLPIINEIFSSPEAIQIPHTNPLARMRNTVGRYIPPEVVAVRVPLLHLSNFTNDWAELSTRSYAVMVLVLPMNGLRKWREHELELVQVVADQVAVALSHAAILEDSMRAHDQLMEQNIALDVARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEMFPMPSDGQFYLRVQVRDTGCGISPQDIPLVFTKFAESRPTSNRSTGGEGLGLAICRRFIQLMKGNIWIESEGPGKGTTVTFVVKLGICHHPNALPLLPMPPRGRLNKGSDDLFRYRQFRGDDGGMSVNAQRYQRSL

SEQ ID NO: 26595 - protein, 635 aa, Lycopersicon esculentum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPINLPIINEIFSSPEAIQIPHTNPLARMRNTVGRYIPPEVVAVRVPLLHLSNFTNDWAELSTRSYAVMVLVLPMNGLRKWREHELELVQVVADQVAVALSHAAILEDSMRAHDQLMEQNIALDVARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEMFPMPSDGQFYLRVQVRDTGCGISPQDIPLVFTKFAESRPTSNRSTGGEGLGLAICRRFIQLMKGNIWIESEGPGKGTTVTFVVKLGICHHPNALPLLPMPPRGRLNKGSDDLFRYRQFRGDDGGMSVNAQRYQRSL

SEQ ID NO: 26596 - protein, 174 aa, Lycopersicon esculentum
MDLIDKAKNFVSEKIANMEKPEATITDVDLKGIGFDGLAFHAKVSVKNPYSVPIPIMEIDYVLKSATRVIASGRIPDPGSIKANDSTMLDVPVKVPHSVLVSLVRDIGGDWDVDYTLELGLIIDIPVIGNITIPLSYSGEYKLPTLSDLWKGGKEEEKKEDEEEKEDPSKVVEI

SEQ ID NO: 26597 - protein, 160 aa, Lycopersicon esculentum
MADFMEKAMDFVSDKVEKPEADITDFDLKKVSMDSISYHAKVAVKNPYSVPVPIMQISYTLKCSGRVIVSGTIPDPGNIKANDTTILDVPVKVPHSMLVSLGKDIGKDWDIDYKLELGLAIDLPVIGDFTIPLSHSGEIKLPSLSDLWNGDKQEDTEKEI

SEQ ID NO: 26598 - protein, 203 aa, Lycopersicon esculentum
NGLFKKANELTVLCDAKVSIVMISSTGKLHEFISPSITTKQLFDLYQKTIGVDIWTTHYEKMQEQLRKLKDVNRNLRKEIRQRMGESLNDLNYEQLEELMENVDNSLKLIRERKFKVIGNQIETYRKKVRNVEEINRNLLLEFDARQEDPYGGLVEHDGDYNSVLGFPTGGPRILDLRLQPNNNYHNHLHSGGGSDITTFALG

SEQ ID NO: 26599 - protein, 234 aa, Lycopersicon esculentum
MDQQLPPTNFPVDFPVYRRNSSFSRLIPCLTEKWGDLPLKVDDSEDMVIYGLLKDALSVGWSPFNFTAGEVKSEPREEIESSPEFSPSPAETTAAPAAETPKGRHYRGVRQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVGCQIEQLTGVHQLLVI

SEQ ID NO: 26600 - protein, 461 aa, Nicotiana alata
MGFTSVKTLILIQLLVVILSSFSELSFGERIERSLIDKGQHHPIFSTVHLFFGKSPKKSPSSPTPVNKPSPSPPAKSPPPQVKSSPPPPAKSPPPPPAKSPPLPPPPVQPPKQSPPPSPAKQPPPPPPSAKPPVKPPSPSPAAQPPATQRATPPSQPPPMQRAPPPKLPLPPPPAQLPIRQPPPPATQLPIRKPPPPAQLPIRQPPPPATQLPIRKPPPPAYTQPPFKTPPPPPIRSSPPPQDAYDEPPVVESPPAPPSDHDPPVVEPPPSDYEPPIIEPTPPTDQPPIIIPSPPTLAPPFIPPITPPVKLPPPSIHPAGKPLIIVGHVHCKSCNSRGLPTLYKASPLQGAVVKLVCHNNARKANVQTAMTDKNGEFVIMPMSLTRADVHKCKVYLGKSPKPICNVPTNFNGGKSGALLKPILPPKPHVNPGPGPVQPPMFDYHGVGPFIFEASSKLPCKK

SEQ ID NO: 26601 - protein, 372 aa, Nicotiana plumbaginifolia
MRCVVLENMGLLCSRNKGYNQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWRDPAIQETILRGNELQVPDCAHYFMENLQRFSDVNYVPSKEDVLFARIRTTGVVEIQFSPVGENKKSGEVYRLFDVGGQRNERRKWIHLFEDERKNRMMETKELFEWVLKQPCFEKTSFMLFLNKFDIFEQKALKVPLNVCEWFKDYQPVSTGKQEIEHAYEFVKKKFEESYFQCTAPDRVDRVFKIYRTTALDQKLVKKTFKLVDETLRRRNLFEAGLL

SEQ ID NO: 26602 - protein, 233 aa, Nicotiana tabacum
MYQPISTELPPTSFSSLMPCLTDTWGDLPLKVDDSEDMVIYGLLSDALTAGWTPFNLTSTEIKAEPREEIEPATIPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTAKRRSPEPASSSISSALENGSPKRRRKAVAAKKAELEVQSRSNAMQVGCQMEQFPVGEQLLVS

SEQ ID NO: 26603 - protein, 225 aa, Nicotiana tabacum
MAVKNKVSNGNLKGGNVKTDGVKEVHYRGVRKRPWGRYAAEIRDPGKKSRVWLGTFDTAEEAAKAYDTAAREFRGPKAKTNFPSPTENQSPSHSSTVESSSGENGVHAPPHAPLELDLTRRLGSVAADGGDNCRRSGEVGYPIFHQQPTVAVLPNGQPVLLFDSLWRAGVVNRPQPYHVTPMGFNGVNAGVGPTVSDSSSAVEENQYDGKRGIDLDLNLAPPMEF

SEQ ID NO: 26604 - protein, 291 aa, Nicotiana tabacum
MASPQENCTTLDLIRQHLLDDNVFMEHYCPQPILYSQSSSSSESLNSIASELNNETFSFEPTLKYADTAQSSNLDISSFFNNSKTEFDSFEFETKPNVSAARISSNSPKQTSFKERKPSLNIAIPMKQQEVVQKVEVVPTEKKHYRGVRQRPWGKFAAEIRDPNRKGTRVWLGTFDTAIEAAKAYDRAAFKLRGSKAIVNFPLEVANFKQQDNEILQPANSGRKRMRETENEEIVIKKEVKREERVPAAAAPLTPSSWSAIWEGEDGKGIFEVPPLSPLSPHMAYSQLVMI

SEQ ID NO: 26605 - protein, 277 aa, Nicotiana tabacum
MDSSSCSSHFFYPMNSDLSSDSSWEWSNLNSTSLPFNVNDSEEMLLFGVLTNTAQETTSETVTSYHVKEEEVSSKSKVIKEIEEKPAKEKSFRGVRRRPWGKFAAEIRDSTRNGVRVWLGTFDSPEAAALAYDQAAFLMRGTSAILNFPVETVQESLRDMKCHVDEECSPVVALKKRHSLRKKSLSSKKSNSSSNSKVVREVKMENVNVVVFEDLGPDYLEQLLSSSSSDHSSCNEAFYHVNQRFTQLCIYLFIYLYYFCLFSFRGREIGEFHLFVL

SEQ ID NO: 26606 - protein, 236 aa, Nicotiana tabacum
MNQPIYTELPPANFPGEFPVYRRNSSFSRLIPCLTETWGDLPLKVDDSEDMVIYTLLKDALNVGWSPFNFSAGEVKSEQREEEIVVSPAETTAAPAAELPRGRHYRGVRRRPWGKFAAEIRDPAKNGARVWLGTYETDEEAAIAYDKAAYRMRGSKAHLNFPHRIGLNEPEPVRVTAKRRASPEPASSSENSSPKRRRKAVATEKSEAVEVESKSNVLQTGCQVELLTRRHQLLVS

SEQ ID NO: 26607 - protein, 234 aa, Nicotiana tabacum
LPLPFFNMDTSHWPQGIGLAKAVEPSKPVPVTERKPRPQKEQAINCPRCNSTNTKFCYYNNYSLSQPRYFCKTCRRYWTDGGSLRNVPVGGGSRKNKRSNSSSNNSSSSTSSSYKKIPDLTIPTSSSTQNPKIINEPHDLNLTFNPSTTSNFSNISEFMALPLMNPNSTTSFMSSIMPQISDSNNIMYSSSSTGLPNLHDLKPTLNFSLDGFDNNNGYGSLQGETAGAKLFFPL

SEQ ID NO: 26608 - protein, 238 aa, Nicotiana tabacum
VKPMEEIIPKNTNTITTICSSKPSTHIERKIRPHQKDQALNCPRCNSTNTKFCYYNNYSLSQPRYFCKTCKRYWTEGGSLRSIPIGGGSRKSKKSSSTNCSSSNTVLREFSKNVVAPVLDPPKMEGSQDLNLGFSCDFKTISELIQVPNNSFMPMPISDPNSVYSSLNFSLDYGLGISGDYENNLQDVQDSTTSGRLLFPFEDLKQISNTSIDCAEENRDGESNGYWNAVLGGNGGSW

SEQ ID NO: 26609 - protein, 114 aa, Nicotiana tabacum
MDTAQWPQEIVVKGMEEIIPKSINTITTICSSKPSTHVERKIRPHQKDQALNCPRCNSTNTKFCYYNNYSLSQPRYFCKTCKRYWTEGGSLRSIPVGGGSRKSKKSSSTNSSSS

SEQ ID NO: 26610 - protein, 119 aa, Nicotiana tabacum
SSNWLQDTVHEETELDSSSSPSGDIFTCSRPLIERKLRPQHDQPLKCPRCDSTHTKFCYYNNYSLTQPRYFCKSCRRYWTKGGTLRNIPVGGGCRKNKKVSSKKLSNENATITKILDHP

SEQ ID NO: 26611 - protein, 262 aa, Nicotiana tabacum
  unsure (1)..(262): unsure at all Xaa locations
MDTSHWPQGIGLVKAVEPSKPVPTERKPRPQKEQAINCPRCNSTNTKFCYYNNYSLSQPRYFCKTCRRYWTEGGSLRNVPVGGGSRKNKRSSSSSNNSSSSTSSSYKKIPDLTIPTSSQNPKIINEPHDLNLAFNPSATSNFSNISEFMALPLMNPNSTTSFMSSIMPQLSDSNNIMYSSSSTGLPNLHDLKPTLNFSLDGFDNNNGYGSLQGETAGXKLFFPLDDLKNVSTPNDDHEFDEQNRGQAAESHGFWNGMLGGGS

SEQ ID NO: 26612 - protein, 502 aa, Nicotiana tabacum
MEHSLMSTGSYFLLFSSSAFLLILLSFSVEKSHALETRETIESHFHTLQLSSLLPSSSCNPATKGKRRGASLEVVNRQGPCTLLNQKGAKAPTLTEILAHDQARVDSIQARITDQSYDLFKKKDKKSSNKKKSVKDSKANLPAQSGLPLGTGNYIVNVGLGTPKKDLSLIFDTGSDLTWTQCQPCVKSCYAQQQPIFDPSTSKTYSNISCTSAACSSLKSATGNSPGCSSSNCVYGIQYGDSSFTIGFFAKDKLTLTQNDVFDGFMFGCGQNNKGLFGKTAGLIGLGRDPLSIVQQTAQKFGKYFSYCLPTSRGSNGHLTFGNGNGVKASKAVKNGITFTPFASSQGTAYYFIDVLGISVGGKALSISPMLFQNAGTIIDSGTVITRLPSTAYGSLKSAFKQFMSKYPTAPALSLLDTCYDLSNYTSISIPKISFNFNGNANVELDPNGILITNGASQVCLAFAGNGDDDSIGIFGNIQQQTLEVVYDVAGGQLGFGYKGCS

SEQ ID NO: 26613 - protein, 410 aa, Nicotiana tabacum
MQSTAISFSPSISLPSKNRHNLLSLSPSRLPLRFGSANGFSTTAPHKLNSVRCSSSSSKLNGSGWISDPLPVPERDSGGVTVRVTSSEPEISAGEEEPPKSKPLADTLVLGSLFGLWYIFNIYFNIYNKQVLKTFHYPVTITLAQLAVGTILVIFMWTSNLYKRPKISGAQLAAILPLAVVHTLGNLFTNMSLGKVSVSFTHTIKAMEPFFSVVLSAMFLGEFPTLWVISSLVPIVGGVGLASLTEASFNWAGFWSAMACNLTNQSRNVLSKKFMVRKEESLDNITLFSIITIMSFILLAPFAFFMEGVKFTPAYLEASGLNVNQIYTRSLLAALCFHAYQQVSYMILERVSPVTHSVGNCVKRVVVIVTSVLFFRTPVSPINTIGTGVALAGVFLYSRVKGIKPKPKTA

SEQ ID NO: 26614 - protein, 411 aa, Nicotiana tabacum
MQSTAISFSPSISLPKKPHNPSSSASLFRFNPLSAQSSRPTLRFGCLNGSVARKINPIRCSADSLNRNGWISVPPPAPERESDGVEVRATSVPESAGEAPKSKPLTDTLVLGSLFGLWYLFNIYFNIYNKQVLKAFHYPVTVTLVQFRVGSVLVILMWTLNLYKRPKISGAQLVAILPLAVVHTLGNLFTNMSLGKVAVSFTHTIKAMEPFFSVVLSAMFLGEFPTIWVMSSLVPIVGGVALASLTEASFNWAGFWSAMASNLTNQSRNVLSKKFMVRKEDSLDNITLFSIITIMSFFLLAPYAFFAEGVKFTPAYLEAAGVNVNQLYTRSLIAALCFHAYQQVSYMILQRVSPVTHSLGNCVKRVVVIVTSVLFFRTPVSPINGLGTGVALAGVFLYSRVKRIKPKAKTE

SEQ ID NO: 26615 - protein, 478 aa, Nicotiana tabacum
MALAPHSNFLANHETIKYYVGSKLPGHKRFSWGWEDYFGSIVVAKICSSRRIPRYFRKSPRICCGLDSRGLQLFSHGKHNLSPAHSINQNVPKGNSGCKFPKDVALMVWEKWGQFAKTAIVAIFILSVASKADAVDALKTCTCLLKECRLELAKCISNPACAANVACLQTCNNRPDETECQIKCGDLFENSVVDEFNECAVSRKKCVPRKSDVGDFPVPDPSVLVQKFDMKDFSGKWFITRGLNPTFDAFDCQLHEFHTEENKLVGNLSWRIRTPDGGFFTRSAVQKFVQDPKYPGILYNHDNEYLLYQDDWYILSSKVENSPEDYIFVYYKGRNDAWDGYGGSVLYTRSAVLPESIIPELQTAAQKVGRDFNTFIKTDNTCGPEPPLVERLEKKVEEGERTIIKEVEEIEEEVEKVRDKEVTLFSKLFEGFKELQRDEENFLRELSKEEMDVLDGLKMEATEVEKLFGRALPIRKLR

SEQ ID NO: 26616 - protein, 273 aa, Nicotiana tabacum
MTLEALKSPTAATPTLPPRYEDDDEIHNLDSWAKGKRSKRPRIDAPPTEEEYLALCLIMLARSGTGTRTGLTDATTSQQPADKKTAELPPVHKKEVATEQAEQSYKCSVCDKAFSSYQALGGHKASHRKTTTTATAASDDNNPSTSTSTGAVNISALNPTGRSHVCSICHKAFPTGQALGGHKRRHYEGKLGGNSRDLGGGGGGGHSGSVLTTSDGGASTHTLRDFDLNMPASPELQLGLSIDCGRKSQLLPMVQEVESPMPAKKPRLLFSLG

SEQ ID NO: 26617 - protein, 298 aa, Solanum tuberosum
MCGGAILYDIIPRDRRLSSTDLWPSSADFWQTSSFSKPISTQNVPPKPKRAQLSRGSEQMKKRQRKNLYRGIRQRPWGKWAAEIRDPRKRVRVWLGTFNTAEAARAYDREARKIRGKKAKVNFPNEDDDHYYSHPEPPPLNIVYESYDTTSTYNQESNNCYPFHSIENTEPVMEFAIANKNSSGSAYNGIEDQNVEGEEQTVKNSNNRIVEEEEKTEDEVQILSDELMAYESLMKFYEIPYVDGQSVAATVNPAADTEVGGGSMELWSFDDVSRLQPSYNVSLIIVLFKLLHLFSLLN

SEQ ID NO: 26618 - protein, 393 aa, Solanum tuberosum
YAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 26619 - protein, 198 aa, Solanum tuberosum
MAELEAKKVEIVDPAPPAPGPVEAPKEVVADEKAIVAPALPPPAEEKEKPDDSKALVVVETKAPEPADEKKEGSIDRDAVLARVATEKRVSLIKAWEESEKSKAENKAQKKVSAIGAWENSKKANLEAELKKMEEQLEKKKAEYTEKMKNKIALLHKEAEEKRAMIEAKRGEDLLKAEELAAKYRATGTAPKKILGIF

SEQ ID NO: 26620 - protein, 161 aa, Antirrhinum majus
LKTKKITLRSSDGEVFEVEESLALESQTIKHMIEDDCADNVIPLPNVTGKILSKVIEYCKRHVDAAAAKADDKLASTGTSDDELKAFDADFVKVDQATLFDLILAANYLNIKTLLDLTCQTVADMIKGKTPEEIRKTFNIKNDFTPEEEEEVRRENQWAFE

SEQ ID NO: 26621 - protein, 165 aa, Antirrhinum majus
SSSDNASKKITLRSSDGEVFEVDEAIALLSQTIKHMIEDDCADNVIPLPNVTGKILSKVIEYCKRHVDADAAKSEEKVAAAAAGDDDLKAFDADFVKVDQATLFDLILAANYLNIKTLLDLTCQTVADMIKGKTPEEIRKTFNIKNDFTPEEEEEVRRENQWAFE

SEQ ID NO: 26622 - protein, 119 aa, Antirrhinum majus
TIIPVPNVTSKILAKVIEYCKRHVEAAAKTDADDGQGDRDALKVFDAEFVKVDQGTLFDLILAANYLNIKSLLDLTCQTVADMIKGKTPEEIRKTFNIKNDFTPDEEEEVRRENAWAFE

SEQ ID NO: 26623 - protein, 234 aa, Antirrhinum majus
MGRGKIVIQRIDKSTSRQVTFSKRRSGLLKKAKELAILCDAEVGVVIFSSTGKLYEFSSTSMKSIIERHTKTKEDHHQLLNHGSEVKFWQREAATLRQQLQDLQENHRKLMGEELQGLNVEDLHRLENQLEMSLRGVRMKKVQMLTDEVHELRRKGHLIHQENNELYEKVKLLQQENKELCKKAYGTRDVSAANGTALVPFGFAIGREQFEPIQLHLSQPEPENIETSRASGSK

SEQ ID NO: 26624 - protein, 302 aa, Antirrhinum majus
MVSSHRSLMEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 26625 - protein, 174 aa, Helianthus annuus
MTLEDFLVKAGVVAESSPGKVNEEGNLEPQETQWIGYQSHAVQQQNMIMAGHYQVQPSVTVPGNSLMDVGYMSPTSLMGSLSDRHMSGRKRFASGDVMEKTVERRQKRMIKNRESAARSRARKQAYTHELENKVSRLEEENERLRREKEVEKVIPWVPPPKPKYQLRRTSSAPF

SEQ ID NO: 26626 - protein, 246 aa, Helianthus annuus
QHVPGPSLARQSSINLAQDLRKKTVDEVWQGIQQGKNKGSNNSSGSGNNDGDKRGNRERQPTLGEMTLEDFLLKAGVVTGSGKKNVDVNQENANHQQAQWMQYQVAPIPQQHVYMSGHHPVQQSLSIGANPMMDMVYPETQMAMSPSHLMHNLSDTQTPGRKRVASGDVIEKTVERRQKRMIKNRESAARSRARKQAYTHELENKISRLEEENELLKRQKEVGMVLPSAPPPKPKYQLRRTSSASF

SEQ ID NO: 26627 - protein, 236 aa, Helianthus annuus
MDFHGFAEHALELRLSTTSSVAENTTNPIKKPSPSSDHCLEPSLTLALSGDSCGGSSFSIASAKREREVPSEESERGGENTSGEEDEDGGVNGKKKLRLTKAQSGLLEEAFKLHTTLNPKQKQELARDLKLRPRQVEVWFQNRRARTKLKQTEVDCEYLKRCCNTLTDENQRLRQEVQELKAQKVSPALYMQLPTTTLTVCPSCEQIGDTKSATSKNPCTKKPSFFNPFTSSSAAC

SEQ ID NO: 26628 - protein, 80 aa, Helianthus annuus
TSMAFNMEESSKKRPFLSSFDDILEEEYYDEQLTEKKRRLSPEQVHMLEMSFEEENKLEPERKTELAKKLGLQPRQVAVW

SEQ ID NO: 26629 - protein, 923 aa, Avena sativa
MASKGAGGGGGGHEEPQRPKQQLPRDSRGSLEVFNPSSSSAAVEPPSAFRPAARSASPFIEEATGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALANGSNYCGRVLNYKKDGTAFWNLLTIAPIKDEEGRVLKFIGMQVEVSKYTEGNKDTVVRPNGLPESLIKYDARQKDQARSSVSELLLAIKNPRSLSESTNSTFKRKSQESVGALTGDRPGKRSSESGSRRNSKSGARTSLQKISEVPERGSKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPIFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDDTDKGMGDAAAADTHTDMF

SEQ ID NO: 26630 - protein, 927 aa, Avena sativa
MASKGAGAGGGGGGGDGYDEPQRPKQQLPRDSRGSLEVFNPSSSAVEPPSAFRPAARSASPFIEEVAGGIEDVGKATQRAAEWGLVLQTNEQTGRPQGVSARSSGGGGSARSSSDDKAVAGAIPRVSEELRAALSAFQQTFVVSDASRPGHPIMYASAGFFNMTGYTSKEVVGRNCRFLQGSGTDPAEIAKIRQALADGSNYCGRVLNYKKDGTAFWNLLTIAPIKDEEGRVLKFIGMQVEVSKYTEGNKDTAVRPNGLPESLIKYDARQKDQARSSVSELLLAIKNPRSLSESTNSTFKRKSQESVGPLTGDRPGKRSSESGSRRNSKSGARTSLQKISEVPERGNKSRKSGLYSLMSLLGMGPGNIEKDMLKPRDEDPLLDSDDERPESFDDELRRKEMRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGTEHVRDAAEREGVMLIKKTAENIDEAAKELPDANLRPEDLWANHSKVVLPKPHMKDSASWRAIQKVLEGGENIDLKHFRPVKPLGSGDTGSVHLVELLNTGEYFAMKAMDKNVMLNRNKVHRANAEREILDMLDHPFLPTLYASFQTKTHICLITDYYPGGELFLLLDRQPLKVLREDAVRFYAAEVVIALEYLHCQGIIYRDLKPENILLHRDGHISLTDFDLSCLTSCRPQVFLPEEANKKSRRKSRSSPVFFAEPMRASNSFVGTEEYIAPEIITGAGHTSAVDWWALGILLYEMLYGYTPFRGKTRQRTFANILHKDIRFPASISVSLPARQLIYRLLHRDPSNRLGSYEGSNEIKEHPFFRGINWALVRGTAPPKLDAPLFPDGTDKGLGDATAAADNHTDMF

SEQ ID NO: 26631 - protein, 391 aa, Hordeum vulgare
MERVFSVEEIPDPFWGQPSPRQRGRRPPEGAMNRCPSEWYFQKFLEEAVLDSPAADPSPMSGASGRGQAACRPRGVAGTATGPAVDPVEYNAMLKQKLEKDLAAVAMWRASGAMPPERFAASPSCPNADGQHIGTINPIGGNVVPLQNKLAGGASGVSGPHLVQNADALVKQAASSSSREQSEDDDMEGEDEITGNGVPTDQRLRRRKQSNRESARRSRSRKAAHLNELEAQVSQLRVENSSLLRRLADVNQKYNGAAVDNRVLKADVETLRAKVKMAEDSVKRVTGMSALFPAGSDMSSLSMPFTGSPSEATSDAAFPDDLSAYFSTSEAGGNNGYMPEMASSAQEDDNFLNETMDTSKMGRPDSLHRVASLEHLQKRMCGGPASSGSTS

SEQ ID NO: 26632 - protein, 579 aa, Hordeum vulgare
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 26633 - protein, 410 aa, Hordeum vulgare
MAAMWSPIIGLLLLLLPLGPSSAIKFPLEGNVYPVGHFYATLNIGEPAKPYFLDVDTGSNLTWLECHHPVHGCKGCHPRPPHPYYTPADGNLKVVCGSPLCVAVRRDVPGIPECSRNDPHRCHYEIQYVTGKSEGDLATDIISVNGRDKKRIAFGCGYKQEEPADSPPSPVDGILGLGMGKAGFAAQLKGHKMIKENVIGHCLSSKGKGVLYVGDFNPPTRGVTWAPMRESLFYYSPGLAEVFIDKQPIRGNPTFEAVFDSGSTYTHVPAQIYNEIVSKVRGTLSESSLEEVKGRALPLCWKGKKPFGSVNDVKNQFKALSLKITHARGTNNLDIPPQNYLFVKEDGETCLAILDASLDPVLKELNFILIGAVTMQDLFVIYDNEKKQLGWVRAQCDRVQELESVIDSRL

SEQ ID NO: 26634 - protein, 295 aa, Hordeum vulgare
MHSCNDHGQKVKLNVVQADSAAHGVTAHGARTPPASAVALKPALIRVPSPPVGVTAARAETPLPFPASPACPPLPFLIPSSTPPRPDPVVRPRTNQMASARRLLQTYPGQFQAAEPPDALGADSDVVVILAALLCALLCVVGLAAVTGCARSRRGAGGARSAAPDAAAPSKGLKKRALMALPRLAYEDAVAARGAMAGEEREGVLLSECAICLSEFADKEEIRVLPQCGHGFHVACVDAWLRAHSSCPSCRRVVVVIVADAAPRGMPPQPKRCRKCEAMEEASSSSSSAAAQFLP

SEQ ID NO: 26635 - protein, 410 aa, Hordeum vulgare
MAAMWSPIIGLLLLLLPLGPSSAINFPLEGNVYPVGHFYATLNIGEPAKPYFLDVDTGSNLTWLECHPPVHGCKGCHPRPPHPYYTPADGKLKVVCGSPLCVAVRRDVPGIPECSRNDPHRCHYEIQYVTGKSEGDLATDIISVNGRDKKRIAFGCGYKQEEPPDSPPSPVNGILGLGMGKAGFAAQLKGLKMIKENVIGHCLSSKGKGVLYVGDFNPPTRGVTWAPMRESLFYYSPGLAEVFIDKQPIRGNPTFEAVFDSGSTYTHVPAQIYNEIVSKVRGTFSESSLEEVKGRALPLCWKGKKPFGSVNDVKNQFKALSLKITHARGTNNLDIPPQNYLFVKEDGETCLAILDASLDPVLKELNFILIGAVTMQDLFVIYDNEKKQLGWVRAQCDRVQELESVIDSRL

SEQ ID NO: 26636 - protein, 140 aa, Hordeum vulgare
VTEPPCEVKDRCASKLLVLAPGRAALTTPAPNLNSGIDPLSASPSSLGQGEVNAAASSQSNASLSQMDERELKRERRKQSNRESARRSRLRKQQECEELAQKVSELTAANGTLRSELDQLKEDCKTMEVENKQLMGKILG

SEQ ID NO: 26637 - protein, 138 aa, Oryza sativa; identical to SEQ ID NO: 1070

SEQ ID NO: 26638 - protein, 583 aa, Oryza sativa
MAANAGMVAGSRNRNEFVMIRPDGDAPPPAKPGKSVNGQVCQICGDTVGVSATGDVFVACNECAFPVCRPCYEYERKEGNQCCPQCKTRYKRHKGSPRVQGDEEEEDVDDLDNEFNYKHGNGKGPEWQIQRQGEDVDLSSSSRHEQHRIPRLTSGQQISGEIPDASPDRHSIRSGTSSYVDPSVPVPVRIVDPSKDLNSYGINSVDWQERVASWRNKQDKNMMQVANKYPEARGGDMEGTGSNGEDIQMVDDARLPLSRIVPIPSNQLNLYRIVIILRLIILMFFFQYRVTHPVRDAYGLWLVSVICEIWFALSWLLDQFPKWYPINRETYLDRLALRYDREGEPSQLAPIDVFVSTVDPLKEPPLITANTVLSILAVDYPVDKVSCYVSDDGSAMLTFEALSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNNSKALREAMCFMMDPALGR

SEQ ID NO: 26639 - protein, 561 aa, Oryza sativa; identical to SEQ ID NO: 1173

SEQ ID NO: 26640 - protein, 636 aa, Oryza sativa; identical to SEQ ID NO: 903

SEQ ID NO: 26641 - protein, 537 aa, Oryza sativa; identical to SEQ ID NO: 896

SEQ ID NO: 26642 - protein, 368 aa, Oryza sativa; identical to SEQ ID NO: 3846

SEQ ID NO: 26643 - protein, 335 aa, Oryza sativa; identical to SEQ ID NO: 3401

SEQ ID NO: 26644 - protein, 407 aa, Oryza sativa; identical to SEQ ID NO: 3735

SEQ ID NO: 26645 - protein, 228 aa, Sorghum bicolor
KVQLKRIENKINRQVTFSKRRNGLLKKAHEISVLCDAEVAVIVFSPKGKLYEYATDSRMDKILERYERYSYAEKALISAESESEGNWCHEYRKLKAKIETIQKCHKHLMGEDLESLNPKELQQLEQQLESSLKHIRSRKSHLMAESISELQKKERSLQEENKALQKELAERQKAAASRQQQQGAVGPADTDPGPDKLIIVLLHDEAGSAGSAASTKHMLPAADNRRER

SEQ ID NO: 26646 - protein, 424 aa, Sorghum bicolor
KLEALDCGKPYDEAVWDMDDVAGALSTLRDSAEALDKRQNSPVSLPMETFKCHSGESLLGVVGLITPWNYPLLMATWKVAPALAAGCTADVKPSELASVTCLELADICKEVGLSSGVLNIVTGLGPDAVLLCQGSPDVDKVSILLGRFETGKKIMARAAPMVKPVTLELGGKSPIVVFDDVDIDKAVEWTLFGCFWTNGQIAAHISSSYPYKIAKEFNERMVAWAKNIKVSDPLEEGCRLGPVVSEGQYEKIKKFISNAKSEGATILTGGLRTAHLEKGFFIEPTIITDITTSMEILEGGVLVSLCVKISTEDEAIELANHTQYGLAGAVLSGDRERCQRLSEEIDAGCIWVNCSQPCFCQAPWGGNKRSDFGRELGEGGIDNYLSVKQVTEYISDEKWGWYQSPLQAVNEKMARKLVCFIRIK

SEQ ID NO: 26647 - protein, 500 aa, Sorghum bicolor
MTATPAMIGLSAGKRLLATSFGNTDLAPPDAHPSLQFAPAAPKLTVVAHRASASSSSSSSSPAGHARAHAIRALRNHSAPALAPPLPLPLPPPPAADPAPELDSEFEFELESSLEAIVLLQRSMLEKQWQLPFEDEDEDDERLTKAAVVVARSGVSARQRRMSGRRRGPGRKSVTVSPELMQSRNRIYLRGTVSKDLLTHKQVIQLSRKIKDGIWLQHQRSKLKEKLGNEPSYKQLAQSLHISPPELRARMRESFLAREMLTMSNIRLVISIAQKYDNLGVELADLIQGGLIGLLRGIEKFDASRGFRISTYVYWWIRQGVSRALADNSKAFRLPTYLHERLIAIRGAKYALEDQGIAPTVENIAESLNISEKKVHNATEAVNKVLSLDQQAFPSLNGLPGDTLHSYIEDQNVANDPWHGFEERYLKEEVNNLINSNLNERERDIIRLYHGIGKQCHTWEDISRQFGLSRERVRQVGLVAMEKLKHAARRKHLDALLEEY

SEQ ID NO: 26648 - protein, 520 aa, Zea mays
MRATIPALSLLVTPRLPSLAVPLAGGRLREGGRSRTRLRVAAPTSVPGEAAEQAEPSTSAPESGEKFSWRDHWYPVSLVEDLDPSRPTPFQLLNRDLVIWKEPKSGEWVALDDRCPHRLAPLSEGRIDETGCLQCSYHGWSFDGSGACTKIPQAMPEGPEARAVRSPKACAIKFPTLVSQGLLFVWPDENGWEKAAATKPPMLPKEFEDPAFSTVTIQRDLFYGYDTLMENVSDPSHIEFAHHKVTGRRDRARPLTFRMESSGAWGYSGANSGNPRITATFEAPCYALNKIEIDTKLPIFGDQKWVIWICSFNIPMAPGKTRSIVCSARNFFQFTMPGKAWWQLVPRWYEHWTSNLVYDGDMIVLQGQEKIFLAATKESSTDINQQYTKITFTPTQADRFVLACRTWLRKFGNSQPEWFGNPTQEALPSTVLSKREMLDRYEQLSLKCSSCKGAYNAFQNLQKVFMGATVVCCAAAGIPPDVQLRLLIGAAALVSAAIAYAFHELQKNFVFVDYVHADID

SEQ ID NO: 26649 - protein, 433 aa, Zea mays
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQKPVAPAKNTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPSHPPAQFPTTTNPFFFP

SEQ ID NO: 26650 - protein, 604 aa, Zea mays; identical to SEQ ID NO: 5821

SEQ ID NO: 26651 - protein, 1969 aa, Dictyostelium discoideum
MEKSEQTNSFESSNNNNNNIDSNINNNLENNNNKNNNNNNNNNNNNNNNNNNIENSIDKNNKEDNSLVGVNSHRKHRTRLKSKKGNKHETKKEIDYKDLLIKLPHNAVSNFNSLENESSDNLTPPPPINSSPLPLPLSLPLPLSLPLPLPLPLPLPLPLPPNKENIEINMEDIIIPENKIKNKNNNNNIDINNNNNNNNEKQTSIIEMEDLDKLKQPKINEGSTGKKGKSHFFSFLQRGDKTNSSILKSSEQPTHKKTKTNINTPPDYPIHYFGHHKRFSSSSDEGSDNSKSQHSSVNTPTLSRHNIDSLPESQQSQKQSQQQSQQPQQQNKTKQIQQTILNNNNDNLNEVTPIKKSSLPTLEVSPIQSNIINNQTTEKHNSGGFTALTSASAMNHQNQRRYREHHQINHQQQQQQHHRHYHHHINSGGSSGSSDKFDYVSATGLSTKNGFNPKSLDVDHFPISDKRNNINIQAPSTPVQSRNYPLFTTQSPKNANSASKSKNKLKNLKRKIASSITGNNPSGISSSAFNHSFSSWNNNNSVYTGGNSGGGSGGGGSGGGGGGGGGGGGIGTPSSFLDDNNNLNNGENFKNSNSYNNNNGSNRSISHDEWLRQFYHKHLERYEKTKAVDYLIIKPWNFISWILRPSRIANYQSKILYRRAYILNFLNLVLFVVYLLSTILSSNEWFIFAPGILLSVIYFFLGKINNKMYLIAFLTISTAVAINITSIIYDLTHTRPTDKLIFSWDLLVMIMVPLLFPSIVYSIVILISVAVTYIGLGIYVQSSHNFYLLDAYDSFGELLRSIIIVFVILMFYTILSSVDLKEIERKESRIQSLFRISNEALVVHKDGLITDANPAFESMFQIKLQDLLYPIQSGIWEFLPALEGMFEPGASKLFDNPDMGVIETTGIDSSGRTFQVEVRTNKATYDGEPVDVISIIDITGRKQLMEADYALRKAEAANEAKVIFLTTVSHELRTPINGVLASADILERTTLDSTQKEFLNCIKLSGNYLLDLINDILDYSKIEAGKMEIIKYDFSILKMLDNSIRIVSKNIYEKGLDLFIFIDPNVPVIVNGDQRRIKQILLNFLSNSIKFTNHGQIIIRVKLVTDDSTHSLIKFDVEDSGIGIKTEHLNPLFASFSQIDSGNSRKYRGTGLGLSISKRLCKMMGGDVKVKSEFGVGSTFSFTIPCGIPNTTTRFSLQSLGSAIYMGEDIQGINKPIGKKKYGASGVVGIVIDSNKYTRKSISQYFAILKISCVDFENKKEFENYLSTLATVDQTTNPQVYLVITSIIDINQLTTNGLPRDRIYHWILMESPNEERKLPLEFENRFVKPAQFADIVRCLYKIDSINFFIEQMAGSPYKASKDLQSGGSSNESGDGGRSLSGGGGGVGSNGNGNGGGGLDSNISPSELSSSEHQLISTPLSDVNEFEDINLINQSLSGLGPSAKVLNSTYFNGLSQSSKIYNNNNRNGVGIGNHHHDHYYQHRHHHSLPPEEIDYDESPFLFLNKPIRKVYHSQPSTPVTNGIALMDSSSKCPSIPSSSSASASALSPNSRHSNELGNGKTTQSFVFSPTSRKFSLNDSFNPSISTIVLPQVSYSPSMQGGNFPINMESVYKKIESHNNNFKRSESKPSTPTFLSNQPSPATSNSPQLLQSPTTSTTGSINLSPHRSPNIRLPLEVRSGSLSSLKPLREDEELESISDDHTSHLKGSSHSINQQIPSTIQQQQQQQQQQQQQQQQQQQQQQQQQQQQQQQQQQQQQKPQQQQQKPTTTTTTTSTQLPQNIEKTTTTTTTSTTKPTATSSSSSSSKTTKTQQQQHHPTTTTTTKSEKIEKTAAATTSEKIEKILLVEDNFVNVKIFSKLLKDSGYIFDVAHNGVEAVECVKKGAYDLILMDCQMPEMDGFEATTAIRELEKSNLIESPPSKKHSHVVIVALTANSGYKDKQKCLSVGMNDFLQKPIKTSDILIQMIKNHLN

SEQ ID NO: 26652 - protein, 1225 aa, Dictyostelium discoideum
  unsure (1)..(1225): unsure at all Xaa locations
MIVEVELGFLLSTLFFTIISIILFYFFINNKNNLIDQCQEVTKLNNKDNKIVNNNNNNYNNNNFNKIEEINDDKNKEIIKLINNSNNKNLKIKIQEIDSGNNNNNNNNNNNNNNNNLNKNSNEIFRNFKIFSGSLLVIDQDLNIISSSESVRDIFSNINDINGVNQQVIGSLQNYSFINLVHQKDKDRVSTFLKLKFKNNNNIKHQQFSEDIINEKDELKEIQIEDNKELIIINNNNNNNNDNVLKFGNNNSNNSSIILFQGVYHLNNTDLSKPFNLQVSILPFISENYIVLSLKDLSPPPLRLLLNKTSSALSPRSLSSSSSSSPSSSNNNGNTNNSGSLSPRSSNSNGSAVSPRNVSSNSMSPRGQNSDRSISSPRGSSSSSSSSSNELAISPRNSNGTISSPRTSNLSIESVLNNKSIDMISHLSHELRTPIHSVIASIQLFRSTILTVTQNEYLSIIDTSANTLLELVSNVLDYKRIRSGKLTLNNVDFNLCHVIEDVCAMVSPQAQAKSLQIASFIFIHCPLSFYGDPIRLRQVLLNLIGNGLKYTNKGQVCISVEPEQVNEHCMYLHFQVKDSGIGIKEENMSKLFAGFSQVNNGGTTQEALGSGLGLAISKDLVELMGGKIWCSSNATQNNGEAGCTFHFXIPLETNPKQLPCPIQNFNGLSVLVVDKNPYIQTVLCQYLEGWNCQVIKSSDIKEASNKLKDLRREQIEVVMIDIDNIDFRDFIQFKDAFNRLEFGRIGLITMSSDRSMVNEMGFGTSKLTKPFRQSHLVACLLASMPEHSSSTTNCFSNIVGMNSNINNNNNINNNSNNNNNNMQTHNSNSVYGNGNYGNCTPFSNNNNRIHMMSSGDKPSINNRRMSISLGKIPTFNSGGSNSPRSKKLFEEVLQQQQLQQQLQQQLQQQQQLQQQQQQQQQQQQQQQQQLQQQQQQLNTIDDDSIIIVIQQVLWIVLMKLIKIIIVIXESDELNDDQAPIIAPVQQLSFGRVTRRHSIDIIMFENSRELSELRNLEDSTRYLSPRSMNNNNGNNDNGINGGSGNSLFGSSIKEEIGGTSDTSSLAQSPNSLSPRAPTKIMILDDNPVSLKLMQRILESRGFECYPFDCSEKAVAQLDQVNPAIIFMDCEMPKMNGXECTQLIRKREQESLCLLKDXKIIIALTAHINPEIQVKCFDAGMNDFISKPFKPQCLELILRKWEDCISNNQLNYNNSLINNQTTIQEQV

SEQ ID NO: 26653 - protein, 943 aa, Dictyostelium discoideum
MKIDCKRVSLIGSPEPRWGHTGTTLPNGSGFIVFGGNSNRAFNDIQYYNIFNNSWSKIEAVGNAPSERYGHSAVLYQSQSRPYSDSYQIIFFGGRATSKPFSDINILYVNSNRSFIWKQVTTKSIEGRAGHTAVVYRQNLVVFGGHNNHKSKYYNSVLLFSLESNEWRQQVCGGVIPSARATHSTFQVNNNKMFIFGGYDGKKYYNDIYYLDLETWIWKKVEAKGTPPKPRSGHSATMIQNNKLMIFGGCGSSSNFLNDIHILHIEGANEYRWEQPSYLGLEIPQARFRHTTNFIGGRVYIYAGTGSGNLMGDLHTLEFLDDNNTPLIPITISIPITNSNSIVGSPNTSISCGVSNSGASSSSGGGISGHPSILSSSSSSSYLSTSPLSTSSLASSYQSSQSLQFNQNQNQNNNNNNNNNNNNNIQTTTTTTTNNNNNNNNNNNNNNNNNNVESNQQQQQIQHQTSPMSVLSRSNSNISLNSLNSSSSSILSTPSTLSTTTTTTTTSHASHTSHTSNRSNGSRGGIPSIPPFNGRSSNHNNNNNSNSNNYNNHQQTKTNSAEELILEELKSLNIYDQAACNKDFQTNLKRVEELFNQKIKHEQKYRQSLEEKLGKANHQVSLLTNQIQSIIQKDELTSLKKEYSELKKKHSLLYSEDIDDLPTETCLKLEEIHVKSLEKLRVKKLPSSNQLSTLQQQIPQQPTTIICNNSQIIQQQPLPPLQQQQQQQQQQQQQQQQQQQPLEIQEQLTMLQLQLSQLSQQQQNQIDKQQKQEKLQQEQQQQQLKNINRLSISSNSSTLSSKDSFYFESKIQELSNQLKEKQQAITDRDNKIKDFENQLNKYKLIGLDSMDHYQLLELESSFHNGLKQIGSIKDQRYLNRLVSLEKEKDQLKDQNSCVICASNPPNIVLLPCRHSSLCSDCCSKLTKCPICRSHIENKISIYQ

SEQ ID NO: 26654 - protein, 2150 aa, Dictyostelium discoideum
MELKTFKDLNDDIIGDTSPVINTGDQPNPLRTQQQQLQQQQQQQQQQQQQQQQQQQQQQQQQQQQQHHIPQQLYQKQQQQQHSHSYGNHSFIHNVSPTSPSYDINNNNNNNNNNNNNNNNNNNNNNNSNNNNNNNNNNKNNYNNNYYYSPIENSNISKSLEESVLNQFPHNFNLNSSNNNYLNNSSSLHNINQSVNSLSNNNNNQTNQQPINNNNNNNNNNNNNNSNNSNNSNNNNNGNNNNNITDSPTKSKRHSTYETNIGSHQRRKSIQSLIANSAIHSFSKLKNKPLSSSTPSTVNTCGAVNNNSNNNNNNNNNSTGSLGAIPMDRSFDGNINTITEESTGGNNSPRSNCGSNCGSNGGIPLSPRNLSSLNSGVNVSPRNIHLNNLNNNSSNLPPLSPRHINFHINVSNLNNNNNNNINPNNNPNNSNNSNNNVSPRNNNHNISPRGSNISPRSNNGGSTTISPRNISNNNNIINNINNNNILTPPRNSPRLENVNPTNSPRLLATSLNSTLPIVSSLTSSNNNNQSNNNTNPSINNNNGRNGHCIQTISEEILGNKPVVYNNGNNNNNNNTNNSTTSNNNITTNNNNNNNNNINNNVLSTPRKRTKGNHSKTNSLQDFETSSMNGGDDSISGAGSGGSLRRRNKDDNDENDGNSNNTNSNNSNNNNNNNNNSSNNNNNNSNNNNNNNNNNNNNNNNNNNNNNNNNNNNNNNNNNNNNNNNNNNYHNGATMMMSHNHQSIGMSSSPKKNNFKPFSRNCSLMGMGRRAWAIILGLFIVGSSISILATLVLRYSEENSIADDFARVARDRFTMLRIEFNNRLYITQTLSLLLSVFPSTSEDQFVPFSKLWSDNAEGLEGIMWAPRVSNLDRYTWEIEHSVKIREIVTNPNNSSDMRDVPAAAASDYYPILFSEPQSSNDHFKGYNIYSDMWRRPSLNKTRDTGEKVSVASPYINKLANVPKNSRSNVLLYIYQAVYTYGKVLSTVEDRRHEVIGFASCRFFISRMVSASLQRLTEEDSLDLYVFDLDSTPIGELIYYRASNAGNDDGSSPTNIMNGKMLEDRSDMIYYNTMNVGGRNWMIALRPSRKFTNKHYTFYPYAIGGVCMLLSALVSFWFAVNTKHNIKLSATNEDLHKEIYNRKLAEKALAESQERLELAMEGSEDAVWDWKVNTGELHISSRWFQILKAHDTSYQSRTLYEELKSSSTNNLNFKGDSKNGGSNNGTFNLFKNGKVDSSSPQSITNVNTTNGGGGGELRKSNSGYLYNDELFSPIILEEMVSSPNTHQLAIWNMKFLAELIHPDDKQKFISEIKKTITRETSIMEIECRMRKKYGGYLYIIMRGKVVSNETSFKDNSLRMAGTLRDMTSRKDMQRLILEKEAAEEANKAKSAFVATVSHEVRTPLSGVIGVSDLLLETNLSEEQRDYVQTIQKSSQALLTIINDILDYSKLESRQLKMETLPFSIIETCQAVIHMLSVAANDDVDILLRVPPNVPRIIFGDAMRMRQVLLNLLSNAIKFTSRGHVLTDISVDDSIPPTNTEEEIIHLCITIEDTGIGIPQSLFDSIFEPFSQADNSTTRKYGGTGLGLSITKRLIEEVMGGTIQVSSIVGQGSKFKCIIPFLLPNTSPSDLNLISPSSLPKPFINRSPKSTYSFTDKKNSVPSTPIPSGDILINKVCLLICRDTVTELVFKEQLEWLGMIVKQVPRNVIDSIKNTILNNNNNNNNNNNNNNNNSNNSSSIISPSSLDYSDENEHLDLVLIDLEILTEHLKIPSNVPIIFITPTKFNISKHNGILNKWITKSPNQRVELIRRPAITDKLIPIISKCIKSQVQFTSGSSQLQSQQANLQQQLLHQQLCNNGQTLNNNYNSGGIGGGGGGGGSNTMNGSSGNLSNNNNFGQTPLSSGLVLLVHTGRTPPLFNNNGNSIIPPLELAVDHHGNQQQQLYQQQQQQQNNSSGNFQQFYQQQNNNSNNSFTPTLPNENSNNSIMNNSLNNNNTTPSNVTPTLFTSSPLDLQGRDTPVLQPPAYRKKALIVEDNELNRKVLAQLFKKIDWTISFAENGREALKEITGERCFDIVFMDCQMPVLDGFQTTKIIRSKERENNWKRMNIVALSAGSSSSFVQDCLDSGMDSFMGKPITLATLKDALAKWGGYNN

SEQ ID NO: 26655 - protein, 1671 aa, Dictyostelium discoideum
MSSPHIELHSQRTLSPQPSSNNFELTGNKSCALSASLNGSIDDLNNNNNNNNNNNNNNNNNNNNNNNNNNNNNNNNNNNNNNNDGDKNDKKLLIITNAPTPPLTPPQPTKTQQTLLELNQKFQEQQQQQQQQQQLQKQNKQQQSQKQQEDPPSSQQEEPPLSQQQQEQEQEQEQEQEQEEQSKQKIEGKGGGGEEEECEGGGGGEGEGEEQFKEGDEEEHEGIEIDPNLPTTGYTGKRRSSLQINEASPKLIQTPSVDRTLCILDSLPCPIFQIGIIENTENGNITLTGFANERLTTLLSCSSNLLVDSLKSIPSPHYNTVPSLESCNSIPINNLAPGLLPNTDPTKILDPYISLYNKKQLKERYSNNNNNTNTNNNNNNNNNNNNNNNNNNNNNNNDTTTTTTTTTTTTTTTTTTTTTTTTNESDNNNNNNNNNNNNNNNNNNNNNNNEEIKQNTKEGEEILHESTNSTGTGNSISRPNSILQCILDSFHEQKTITEKVLLSNFLIRQQYKSRATIKPFPDGCICIFEYIENINLNYQQPPTSLNDRINSTNKLTNEMELLSLSPDSNHQHVQKLHNHNHNHHNHNHNNTTQRASSTDSPFIHSVSANSLSSMSSNSSVTSACASLSSNSSSNSNNNSNNASSSNCSSNANSNNTNSSSSNCCCCCNNNNNNNTSSTSSTISSASSTKSKSYLHQQHKNSKVYSTLLNSFENLSFLLKSTPIIIWRADHNGEMVFFKKSDEIPIDEKKVVGNNFQDFLQWVPQTYRTNFQEMFQNSLKCGKIFEFLFWFQTPQNYVQLFKIAGYPIFHIDGKDCIASKRYLIGWLGVTYNYLINDGAEISIKGSANLDSMYEKFKIIYEMPNIERTKLTNNGISSGGDITNANNNGGSSESSNKILEKKKHLISEAEKECFLKCKETYNILFKLSLLGVMFSTFKGIILDANDMLLQTIGYTRGDLENGKIDWMLLTPPEHFEISARALQELKAKRWCQPIEKAYIHKSGKRVPVLITSAMIDGSTEQCITFVFDLSRYRQAEMAAIEATRLKTQFITNISHELRTPCHGIVGMSQLLLDSQLTNTQRDNIDSIKRSTDSLISLINDILDFSKLEYGKVTLENESFELLPMIEEVLDSQATAANRKGIDLIFVMGRDYPVPPVIFGDRNSLKKVLLNLVGNAVKFTETGFVLLEISTDYESGDQISLRFTVKDSGIGIPENKIEQIFVPFGQIDGSFSRKYGGSGLGLSFCKELVALMGGYIRVESGDQEGGKGTTFWFAIKVSISSPSYLPNSVPAANQFFYPEYRPSHYNNVIGNGDSPKNVLIIESNQMVIMSIQSILLSMKCECISASKAITALDLLESSKSTENQIDIIVCSDKSTFVQQILDYVTTEKVILYGVDPNSKYNENSKVYSYLVTPITHSKLISSILLSKNLKSKNSFLTTTNNTNNTNNTNNIENKSSIDSPLSITSTSSSIITPILTSNNLDLNNNNNNNNNSILVSNNGGVDGGNNVPSTLTTIQQSQPKKYILVAEDNDINIKVVVRQLEKLGYTAIVGINGLKALEIIGSFPICLILLDCQMPQMDGFTCSTILRQIEPTGQRIPIIAMTANDSKDRCFEVGMDDYLSKPVRVDRLQKTLSDWIKTDENGNPTNSYNFYPLSYSLVYNNFIDTQLKKEKNDD

SEQ ID NO: 26656 - protein, 737 aa, Physarum polycephalum
MAGALWEIEKELFTKLPAPSSAINSHLQPAKPKVPQKKPSKWDPPAEFKVDLSTAVSYNDIGDINWKNLQQFKGIERSEKGTEGLFFVETESGVFIVKRSTNIESETFCSLLCMRLGLHAPKVRVVSSNSEEGTNMLECLAAIDKSFRVITTLANQANILLMELVRGITLNKLTTTSAPEVLTKSTMQQLGSLMALDVIVNNSDRLPIAWTNEGNLDNIMLSERGATVVPIDSKIIPLDASHPHGERVRELLRTLIAHPGHESSQFHSIRDIITLYTGYDVGTEGSISMQEGFLATVRECASFDLDAFERELLSWQESLQKCHNLSISPQAIPFILRMLRIFHDAIHNPSPSSPSPSPSSSSSTSHPTPASSSTSSTLPSSIPSSSNTSPPPASSSESLVGVEECAWLKVVVPNEKPAPRRYHSGVLYEGKLYVFGGVCIKTASNDFYVFDFAKKKWSIVVAQGEAPSPRCGHSATVYGGKMWIFGGHNNNKQPYSDLYTFDFAKSTWEKIEPTKDGPWPSPRYHHSATLVGASLYIFGGAEHKSKYHNDVYVYKFDANQWELLNATGETPEPRAGQMTVEWNNSLFTFGGHGGEGGYTSFVDAHVFEIATNTFHEVDCSGTFPRTARPLSYVPYYYGSGDKREGAVFSFGGSDGKSPLGSLYQWNLKTHKWKIIKAWMAVEDNTIGSMAAIASGKLDPIPRYGHCTVLDDTGVISIFGGSGSLFLDDIVQFDMTES

SEQ ID NO: 26657 - protein, 472 aa, Schizosaccharomyces pombe
MANFGSIVAHNFDFYQVKQQNNLDFYACIKLVNYIRSQVKEGKTPDLDKLSDILRSDEYMISVLPDDSVLFSLGDELDSDFEDDNTLEIEVENPADVSKDAEIKKLKLQNQLLISQLEEIRKDKMNELTSQTTDQLSVTPKKADNDSYYFESYAGNDIHFLMLNDSVRTEGYRDFVYHNKHIFAGKTVLDVGCGTGILSMFCAKAGAKKVYAVDNSDIIQMAISNAFENGLADQITFIRGKIEDISLPVGKVDIIISEWMGYALTFESMIDSVLVARDRFLAPSGIMAPSETRLVLTATTNTELLEEPIDFWSDVYGFKMNGMKDASYKGVSVQVVPQTYVNAKPVVFARFNMHTCKVQDVSFTSPFSLIIDNEGPLCAFTLWFDTYFTTKRTQPIPEAIDEACGFTTGPQGTPTHWKQCVLLLRNRPFLQKGTRVEGTISFSKNKKNNRDLDISVHWNVNGKADSQSYVLN

SEQ ID NO: 26658 - protein, 1183 aa, Schizosaccharomyces pombe
MASRQGFSNVNEDEPELPPSVLSLKSKFESLSTGDLTNLDEKTAKRRTVKGCKNGTSEPNVFKARPIPPPRQVSSTIGSSTGRKVSGSIQRLASNFKNPSNPHADVSKIDRLPSDSSESHVATPSSPTISNSFVSVSPLLKRPQQKGPEISFQSSVQSTKGNDLMKHDDTNNHQIPPPKPNFSSKAGSSSPISVSPLKNVKAYISQSPTHSEASSVLSSEEEEENVINSSKSVPSFDLHDPFSQTFGKECPISTAPPVLNIGDRSLETPPPIPSPRPPQPVAVEAIQQSRAVISQQLPLHVSPRKPPKPPLRKVSTQRSSSPIENLATKSDASLVTGLQSSPYTHIAPASEMSLIPEKPRLPPRPSHTLSELSSPALTSENLSSKPSPLFPPPPPRVKSLATNKPVSMPVSTEQSDPSVAASSSSSSQLDVVLKGSIPDTSSVRRNPPCFVNGVESINVDFEARIFDVSGDRLVLAGNGGLRVYDTVTGLCHWHMPLGDTKVTSLSFKSSPENYSDDGRFVWFGTRDGMLWEVDVQNHHIVTKKSVSNCPITYVMVYKNEMWTLDDMGKLYVWQEDEIMGLSIQSTPHSIRTIPHATHAMVLDNRLLWVVVGKSIYVYDPSTSENESASVLAKPMTPPGLIGDISCGTTISNFTDLVFYGHVDGKISIFSKTQYRFLELITSSSFYRICSLVGVGNTLWAAYTTGMIYVFDVSESPWRLLKSWHGHKASHNGATTILGIDVNSVWKAKRLQVVSMASSVVKFWDGLMMGDWLATEMRSRFPEYSNFTDVSILICSWNAGASKPSDLDSDTIGASMIPMMIRDNGYPDIVVFGFQELVDLENKRLTARSILSKSSSKGGSSNSANISSQYRLWREKLESEMMRVSSNDDYQVLVCENLVGLFSCVFVKNKLQSKIRMLQSTTVKTGLGGLHGNKGAIVVRFLVDDTSYCIVNCHLAAGQSNKAARNNDLATILDNASLFPENDETDQLNTFVGGGDGSLIMDHEVCVLHGDLNYRINTLRPKALDLIKKNDIKTLLQSDQLLVERKRNAGFRLRTFTEPEITFAPTYKYDVHSEQYDSSEKKRVPAWCDRICYRGSPDYISAENYTRYELKASDHRPVSALIHSKAKMVNAQSQGSTWDVVKRKWIEYADEFKRKAKYVFFWRILLTNQNNLCHELYFCVLSNG

SEQ ID NO: 26659 - protein, 578 aa, Schizosaccharomyces pombe
MSSESRENEVKAETKDEIANDGSPQLNGDNNIQSSDGHNDENEESLSRKRDSSGATVGDLKQEEKESMPKKEPEPTVKKIRGSGMPPPQQKYCLAIVRQLKRTKNSAPFKVPVDPIKQNIPDYPTIVKNPMDLGTIEKKLTSYEYSVPQEFIDDMNLMFSNCFLYNGTESPVGSMGKALQEVFERQLKQLPDAEQPAAAPVKKSKQKSASTAPPRTRRNSSVSSTSASVAASTAPKAASPAVLPEGKPRRRKNNSQMRFCSTVLKELYKRQYESFAFPFYQPVDPVACDCPDYFDVIKEPMDLSTIQSKLNKNEYSTLEEFESDILLMFNNCFTYNPPGTPVHVMGRQLENVFKEKWEARPKFDDATLVKQQEAETDALFDNGEEEEALMSEEEINGAKFAAVDKQISMLQDTLEAMKAKKMNRMRKPRRRDLTKEYGPITYAMQNELAERCNYLSAEQLSNVAEILREEMPWLRDTDEIEIDVGNMKPEVFHRIYRYVCKPDADSSEPASPVLMPTKPEKKKGRVLSETEQAEKIRRLQQQLDRFAGKTSPTSPESNNAANVSDSESDNESESSESA

SEQ ID NO: 26660 - protein, 1081 aa, Candida albicans
MNPTKKPRLSPMQPSVFEILNDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGSVEGGGTSSRPVQRRSATEGSITTISEQIDR

SEQ ID NO: 26661 - protein, 1081 aa, Candida albicans
MNPTKKPRLSPMQPSVFEILNDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGIWGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGSVEGGGTSSRPVQRRSATEGSITTISEQIDR

SEQ ID NO: 26662 - protein, 1081 aa, Candida albicans
MNPTKKPRLSPMQPSVFEILSDPELYSQHCHSLRETLLDHFNHQATLIDTYEHELEKSKNANKAFQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDVHAQGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVEDMIGDTPRQGSVEGGGTSSRPVQRRSATEGSITTISEQIDR

SEQ ID NO: 26663 - protein, 1081 aa, Candida albicans
MNPTKKPRLSPMQPSVFEILNDPELYSQHCHSLRETLLDHFNHQATLIDTYEHELEKSKNANKASQQALSEIGTVVISVAMGDLSKKVEIHTVENDPEILKVKITINTMMDQLQTFANEVTKVATEVANGELGGQAKNDGSVGIWRSLTDNVNIMALNLTNQVREIADVTRAVAKGDLSRKINVHAQGEILQLQRTINTMVDQLRTFAFEVSKVARDVGVLGILGGQALIENVEGIWEELTDNVNAMALNLTTQVRNIANVTTAVAKGDLSKKVTADCKGEILDLKLTINQMVDRLQNFALAVTTLSREVGTLGILGGQANVQDVEGAWKQVTENVNLMATNLTNQVRSIATVTTAVAHGDLSQKIDGHPKGEILQLKNTINKMVDSLQLFASEVSKVAQDVGINGKLGIQAQVSDVDGLWKEITSNVNTMASNLTSQVRAFAQITAAATDGDFTRFITVEASGEMDALKTKINQMVFNLRESLQRNTAAREAAELANSAKSEFLANMSHEIRTPLNGIIGMTQLSLDTELTQYQREMLSIVHNLANSLLTIIDDILDISKIEANRMTVEQIDFSLRGTVFGALKTLAVKAIEKNLDLTYQCDSSFPDNLIGDSFRLRQVILNLAGNAIKFTKEGKVSVSVKKSDKMVLDSKLLLEVCVSDTGIGIEKDKLGLIFDTFCQADGSTTRKFGGTGLGLSISKQLIHLMGGEIWVTSEYGSGSNFYFTVCVSPSNIRYTRQTEQLLPFSSHYVLFVSTEHTQEELDVLRDGIIELGLIPIIVRNIEDATLTEPVKYDIIMIDSIEIAKKLRLLSEVKYIPLVLVHHSIPQLNMRVCIDLGISSYANTPCSITDLASAIIPALESRSISQNSDESVRYKILLAEDNLVNQKLAVRILEKQGHSVEVVENGLEAYEAIKRNKYDVVLMDVQMPVMGGFEATEKIRQWEKKSNPIDSLTFRTPIIALTAHAMLGDREKSLAKGMDDYVSKPLKPKLLMQTINKCIHNINQLKELSRNSRGSDFAKKMTRNTPGSTTRQGSDEGSVKDMIGDTPRQGSVEGGGTSSRPVQRRSAREGSITTISEQIDR

SEQ ID NO: 26664 - protein, 623 aa, Candida albicans
MVSSDFENEKQPDVVQVLTDEKNISLDDKYDYEDPKNYSTNYVDDYNPKGLRRPTPQESKSLRRVIGNIRYSTFMLCICEFAERASYYSTTGILTNYIQRRIDPDSPHGWGAPPPGSPDASAGALGKGLQAASALTNLLTFLAYVFPLIGGYLGDSTIGRWKAIQWGVFFGFVGHLFFIFASIPQAIENANAGLGLCVIAIITLSAGSGLMKPNLLPLVLDQYPEERDMVKVLPTGESIILDREKSLSRITNVFYLAINIGAFLQIATSYCERRVGFWLAFFVPMILYIIVPIFLFIVKPKLKIKPPQGQVMTNVVKILSVLFSGNFIKRLWNGTFWDHARPSHMEARGTIYYNSKKKSAITWSDQWILDIKQTFDSCKIFLYYIIFNLADSGLGSVETSLIGAMKLDGVPNDLFNNFNPLTIIILIPILEYGLYPLLNKFKIDFKPIWRICFGFVVCSFSQIAGFVLQKQVYEQSPCGYYATNCDSPAPITAWKASSLFILAAAGECWAYTTAYELAYTRSPPALKSLVYALFLVMSAFSAALSLAITPALKDPNLHWVFLAIGLAGFLCAIVMLAQFWNLDKWMENETNERERLDREEEEEANRGIHDVDHPIEAIVSIKS

SEQ ID NO: 26665 - protein, 2471 aa, Candida albicans
MSMNFFNSSEPARDHKPDQEKETVMTTEHYEFERPDVKAIRNFKFFRSDETETKKGPNLHISDLSPLESQSVPPSALSLNHSIIPDQYERRQDTPDPIHTPEISLSDYLYDQTLSPQGFDNSRENFNIHKTIASLFEDNSSVVSQESTDDTKTTLSSETCDSFSLNNASYLTNINFVQNHLQYLSQNVLGNRTSNSLPPSSSSQIDFDASNLTPDSIPGYILNKKLGSVHQSTDSVYNAIKIPQNEEYNCCTKASASQNPTNLNSKVIVRLSPNIFQNLSLSRFLNEWYILSGKHSSKEHQIWSNESLTNEYVQDKTIPTFDKESARFRPTLPINIPGILYPQEIINFCVNSHDYPLEHPSQSTDQKRFAMVYQDNDYKTFKELSMFTLHELQTRQGSYSSNESRRKSSSGFNIGVNATTTEAGSLESFSNLMQNHHLGATSTNGDPFHSKLAKFEYGVSKSPMKLIEILTDIMRVVETISVIHELGFVHNGLTSSNLLKSEKNVRDIKITGWGFAFSFTENCSQGYRNKHLAQVQDLIPYMAPEVLAITNSVVDYRSDFYSLGVIMYELVLGILPFKNSNPQKLIRMHTFENPIAPSALAPGWISEKLSGVIMKLLEKHPHNRYTDCHSLLHDLIEVKNMYISKLLDSGETIPNSNLNLSDRQYYLTKENLLHPEKMGITPVLGLKESFIGRRDFLQNVTEVYNNSKNGIDLLFISGESGRGKTIILQDLRAAAVLKQDFYYSWKFSFFGADTHVYRFLVEGVQKIITQILNSSEEIQNTWRDVILTHIPIDLSILFYLIPELKVLLGKKYTSIYKHKIGMGMLKRSFKEDQTSRLEIKLRQILKEFFKLVAKQGLSIFLDDVQWCSEESWRLLCDVLDFDSSGEVRESYNIKIVVCYALNADHLENVNIEHKKISFCRYAKQSHLNLREFSIPHIPLEDAIEFLCEPYTRSHDHECNSKKSDVIANLNCTNEYPQNTCKVIPSIIQELYQSSEGNVLLLIFLTRMTKLSGKVPFQRFSVKNSYLYDHLSNSNYGTTRKEILTNYLNMGTNSDTRALLKVAALISNGSGFFFSDLIVATDLPMAEAFQLLQICIHSRIIVPTSTYYKIPMDLIASDQTPFDLTDDNIWKLATLCSYKFYHDSICTHIIKELNASGEFKELSRLCGLRFYNTITKERLLNIGGYLQMATHFRNSYEVAGPEENEKYVEVLVQAGRYAISTYNMKLSQWFFNVVGELVYNLDSKTQLKSVLTIAENHFNSREFEQCLSVVENAQRKFGFDRLIFSIQIVRCKIELGDYDEAHRIAIECLKELGVPLDDDDEYTSENSLETCLGKIPLSVADIRGILKIKRCKNSRTLLMYQLISELIVLFKLQGKDKVRRFLTAYAMSQIHTQGSSPYCAVILIDFAQSFVNETTTSGMLKAKELSIVMLSLINRAPEISLSYVQSIYEYYFSCHAVFFESIEKMSDLIHPGNASSHCTRSSYYSSFHLIVNVSKIFFSCMNGESFKMFSTFKCKSYLTGDPQMPEMDNFLYDSEMLLAGHSELNEFMRKYQSFNQTSVGKFCYYLIVLLVMSREHRFDEAADLVLKVLEDLSEKLPVSFLHHQYYLICGKVFAYHQTKTPESEEQVERILARQFERYELWASTNKPTLLPRYLLLSTYKQIRENHVDKLEILDSFEEALQTAHKFHNVYDMCWINLECARWLISINQKRHRISRMVKQGLKILRSLELNNHLRLAEFEFDEYIEDEDHRNKWAGLTNNPTLDTVTTWQQQNMPDKVSPCNDKQLVHGKQFGKKEFDSHLLRLHFDGQYTGLDLNSAIRECLAISEALDENSILTKLMASAIKYSGATYGVIVTKKNQETPFLRTIGSQHNIHTLNNMPISDDICPAQLIRHVLHTGETVNKAHDHIGFANKFENEYFQTTDKKYSVVCLPLKSSLGLFGALYLEGSDGDFGHEDLFNERKCDLLQLFCTQAAVALGKERLLLQMELAKMAAEDATDEKASFLANMSHEIRTPFNSLLSFAIFLLDTKLDSTQREYVEAIQSSAMITLNIIDGILAFSKIEHGSFTLENAPFSLNDCIETAIQVSGETILNDQIELVFCNNCPEIEFVVGDLTRFRQIVINLVGNAIKFTTKGHVLISCDSRKITDDRFEINVSVEDSGIGISKKSQNKVFGAFSQVDGSARREYGGSGLGLAISKKLTELMGGTIRFESEEGIGTTFYVSVIMDAKEYSSPPFSLNKKCLIYSQHCLTAKSISNMLNYFGSTVKVTNQKSEFSTSVQANDIIFVDRGMEPDVSCKTKIIPIDPKPFKRNKLISILKEQPSLPTKVFGNNKSNLSKQYPLRILLAEDNLLNYKVCLKHLDKLGYKADHAKDGVVVLDKCKELLEKDEKYDVILMDIQMPRKDGITATRDLKTLFHTQKKESWLPVIVALTANVAGDDKKRCLEEGMFDFITKPILPDELRRILTKVGETVNM

SEQ ID NO: 26666 - protein, 1230 aa, Candida albicans
MSILSENNPTPTSITDPNESSHLHNPELNSGTRVASGPGPGPEVESTPLAPPTEVMNTTSANTSSLSLGSPMHEKIKQFDQDEVDTGETNDRTIESGSSDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSSSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 26667 - protein, 1338 aa, Kluyveromyces lactis
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTERSSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 26668 - protein, 1283 aa, Nectria haematococca
MIDDAALAAAAEIVASIAPDSRLPNSIPVGVASQVQLPGRDTPAKRKLEIELQNLALRVGKLESQASATSTFPETPNEAIDTLFGGEDTSNTNVPVTTRPKPKVIHAQGSLHSPHLPSYQLTKEALEGLRDHVDDQSKLLDSQREELAGVNAQLLEQKQLQERALEVLEQERIATLERELWKHQKANEAFQKALREIGEIVTAVARGDLTMKVRMNTVEMDPEITTFKRTINAMMDQLQTFASEVSRVAREVGTEGLLGGQARIGGVDGTWKELTDNVREIASVTTAVAHGDLTKKIERPARGEILQLQQTINTMVDQLRTFASEVTRVARDVGTEGMLGGQADVGGVQGMWNDLTVNVNAMANNLTTQVRDIIKVTTAVAKGDLTQKVQADCRGEIFDLKSTINSMVDQLQQFAREVTKIAREVGTEGRLGGQATVHDVEGTWRDLTENVNGMAMNLTTQVREIAKVTTAVAKGDLTKKIGVEVKGEILELKNTINQMVDRLGTFAVEVSKVAREVGTDGTLGGQAQVANVEGKWKDLTENVNTMASNLTVQVRSISTVTQAIANGDMSQKIKVGANGEIQVLKETINNMVDRLSSFCYEVQRVAKDVGVDGKMGAQADVAGLDGRWKEITTDVNTMASNLTTQVRAFSDITNLATDGDFTKLVDVEASGEMDELKRKINQMISNLRDSIQRNTQAREAAELANKTKSEFLANMSHEIRTPMNGIIGMTQLTLDTDLTQYQREMLNIVNNLANSLLTIIDDILDLSKIEARRMVIEEIPYTLRGTVFDALKTLAVKANEKFLDLTYKVDSSVPDYVIGDSFRLRQIILNLVGNAIKFTEHGEVSLTIKERVEQRNVRPGEYAVEFIVEDTGIGIAKDKLDLIFDTFQQADGSMTRKFGGTGLGLSISKRVVNLMGGDLWVISEQGKGSEFHFTCLVKLAHDDAAMIEQQIRPYRGHQVLFVDKAQSKGGASIKGMLEQIGLHPVVVESEKSPALTRLQASGSLPYDAILVDSIDTARRLRAVDDFKYLPIVLLAPVVHVSLKSCLDLGITSYMTTPCKLIDLGNGMIPALENRATPSLADNTKSFEILLAEDNTVNQRLAVKILEKYHHVVTVVGNGWEAVEAVKRKKFDVILMDVQMPIMGGFEATGKIREYERGIGTHRTPIIALTAHAMMGDREKCIQAQMDEYLSKPLQQNHLIQTILKCATLGGPLLEKNRERELALHAEAKSSKHKEGGQGLLRPALESRSFTSREPLSGNGKESPALLSPDEDPMARVYMRSLSS

SEQ ID NO: 26669 - protein, 1298 aa, Neurospora crassa
MTDGPTLAAIAALVKSLAVDPATTQTSGLRPSTHVRLPGPYTREKGDLERELSALVVRIEQLETAAIAASPPAMPDTPNAPTDALFSNGTLSPSSETPDARYPAPLPRNGFIDEALEGLREHVDDQSKLLDSQRQELAGVNAQLIEQKQLQEKALAIIEQERVATLERELWKHQKANEAFQKALREIGEIVTAVARGDLSKKVRMNSVEMDPEITTFKRTINTMMDQLQVFSSEVSRVAREVGTEGILGGQAQIEGVDGTWKELTDNVNVMAQNLTDQVREIASVTTAVAHGDLTKKIERPAKGEILQLQQTINTMVDQLRTFASEVTRVARDVGTEGILGGQADVEGVQGMWNELTVNVNAMANNLTTQVRDIIKVTTAVAKGDLTQKVQAECRGEIFELKKTINSMVDQLQQFAREVTKIAREVGTEGRLGGQATVHDVQGTWRDLTENVNGMAMNLTTQVREIAKVTTAVAKGDLTKKIGVEVQGEILDLKNTINTMVDRLGTFAFEVSKVAREVGTDGTLGGQAQVDNVEGKWKDLTENVNTMASNLTSQVRGISTVTQAIANGDMSRKIEVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKKKINQMVYNLRDSIQRNTQAREAAELANKTKSEFLANMSHEIRTPMNGIIGMTQLTLDTDLTQYQREMLNIVNSLANSLLTIIDDILDLSKIEARRMVIEEIPYTLRGTVFNALKTLAVKETEKFLDLTYRVDHSVPDHVVGDSFRLRQIILNLVGNAIKFTEHGEVSLTIQKASSVQCSTEEYAIEFVVSDTGIGIPADKLDLIFDTFQQADGSMTRKFGGTGLGLSISKRLVNLMGGDVWVKSEYGKGSKFFFTCVVRLANDDISLIAKQLNPYKSHQVLFIDKGRTGHGPEIAKMLHGLGLVPIVVDSERNPALEKARAAGQAPYDVIIVDSIEDARRLRSVDDFKYLPIVLLAPVVHVSLKSCLDLGITSYMTTPCQLIDLGNGMVPALENRATPSLADNTKSFEILLAEDNTVNQRLAVKILEKYHHVVTVVGNGEEAVEAVKRKKFDVILMDVQMPIMGGFEATAKIREYERSLGSQRTPIIALTAHAMMGDREKCIQAQMDEYLSKPLQQNHLIQTILKCATLGGQLLEKNRERELTRAADAVTGGRRDNGMYSASQAAQHAALRPPLATRGLTAADSLVSGLESPSIVTADKEDPLSRARASLSEPNIHKAS

SEQ ID NO: 26670 - protein, 1154 aa, Neurospora crassa
MNNNYYGSPLSPEELQHQMHQHQQQQQQQQQQQQQQQQQQQQQQQQQQQQHQHQQQQKTNQHRNAGMMNTPPTTNQGNSTIHASDVTMSGGSDSLDEIIQQNLDEMHRRRSVPQPYGGQTRRLSMFDYANPNDGFSDYQLDNMSGNYGDMTGGMGMSGHSSPYAGQNIMAMSDHSGGYSHMSPNVMGNMMTYPNLNMYHSPPIENPYSSAGLDTIRTDFSMDMNMDSGSVSAASVHPTPGLNKQDDEMMTMEQGFGGGDDANASHQAQQNMGGLTPAMTPAMTPAMTPGVSNFAQGMATPVSQDAASTPATTFQSPSLSATTQTIRIGPPPPPSVTNAPTPAPFTSTPSGGGASQTKSIYSKSGFDMLRALWYVASRKDPKLKLGAVDMSCAFVVCDVTLNDCPIIYVSDNFQNLTGYSRHEIVGRNCRFLQAPDGNVEAGTKREFVENNAVYTLKKTIAEGQEIQQSLINYRKGGKPFLNLLTMIPIPWDTEEIRYFIGFQIDLVECPDAIIGQEGNGPMQVNYTHSDIGQYIWTPPTQKQLEPADGQTLGVDDVSTLLQQCNSKGVASDWHKQSWDKMLLENADDVVHVLSLKGLFLYLSPACKKVLEYDASDLVGTSLSSICHPSDIVPVTRELKEAQQHTPVNIVFRIRRKNSGYTWFESHGTLFNEQGKGRKCIILVGRKRPVFALHRKDLELNGGIGDSEIWTKVSTSGMFLFVSSNVRSLLDLLPENLQGTSMQDLMRKESRAEFGRTIEKARKGKIVVAASMRCKTSVARCSRPIQHSTPEMVVRVKGQTFLLAQTKLLKASSRTLRPATVTVKNMSPGGVPLSPMKGIQTDSDSNTLMGGMSKSGSSDSTGAMVSARSSAGPGQDAALDADNIFDELKTTRCTSWQYELRQMEKVNRMLAEELAPVLSNKKKRKRRKGGGNMVRDCANCHTRNTPEWRRGPSGNRDLCNSCGLRWAKQTGRVSPRTSSRGGNGDSMSKKSNSPSHSSPLHREVGNDSPSTTTATKNSPSLRGSSTTAPGTITTDSGPAVASSASGTGSTTIATSANSAASTVSPALLRQVPVAAHRLNIFRLISREHTLTPRPCSVYTSISSISSINSSINSSINSSINSSTNSFSSISSTLHKASHSWKARKRFPWKRNGDDLN

SEQ ID NO: 26671 - protein, 1583 aa, Trypanosoma brucei
SVAAVQVIVGIFSLEVLSPGCLVSFYGEVISSIQKQARVQVRKREEILVHLISLVRILKGHLRPHLKEITSTVDSFISVTDLSVLRQVLALLKELCCSLRRRFRPYMSSLLGPIIVLVEENVEETSEIVLDFFSAMGSLLEDHLHTVLPVVCNIIVDTSVPSRCRIVAVKTLICFTKRLPDLCFHASRCVHCLCRVLRESDGGDGVGDEGRLGCSAMEALCTLAGSLGKNFENFVLVVLPAVADRYGETSGEYCRFCHDIYEAIDGKRAPEVSSNGVGKAGGGGAPSLPFTAGTSASPLKDRADAYASLRFHLRKRDQASDEDWNHWLPQLAVNLLRSSSSPSHGRALTLAELHEPFARQMLHSAFAACYADMDEHTQREVIGLLTEVLRGLRVPSEVMQELLNLSEHMERQGIRLSAGGKASIKHSSNFCPFDRQVLMESSANCNLYSKALHYAEIEFLETVREYERSILRGCPKPLPVEDWQNLIKLCEKSIYFCNLLGQRESANGILKFIRQNLPLLTGKKVTELSQMMDAHLFDKLRWWSQSLQAYERRLQQEPNKVSNMVGLLRALDALGEYPRVLEMWRQFSKRVSKREVSKLASMGAHAAWLLRRWDDMEHITSFMSDEDYTGTTALFYKATLAARKKRFREAEKLIDMCRKRVDSKLSALVAESYDRAYDLFVGIQQLSELEELAMATSDPQSAMHWRQLWERRLSVMAYEGWPGTLANHTLLVPPSSEIDMWLRFVSLSRAHGQGSVSTEVLRELLGNQSIESAIENGIPTPAVAMGSFQHLYETNQRDSAIARLQLYVSKVEGSGAQHVSREREDMAVCHAKLAEWLVHQKKAHRTEDELQKIFHHLRRATELDKSNGSIWRTLARVHREAATKPADGSDSSGASGHIMEALSAYLRSVSLSEELEDALGFLSLWFMYGPLLAVQVGSTLKEEIEEVNPTVWLKVIPQIIARISSSNGTVADSVYNLLVLVARRHPQAILYSLNVAHSSYQGKGTADGVEPLKGSHRVLARIAEIHQNGKAMVEDSALVCRELVRCAVLWPELWFNELGRALYQWERQRSAENLLLAMGPLLEQLKRPETMAEAQFAAELRQPLENACCHVERAVSSRHEQFMEEARRIFVSIERRIREQISGMSSLALQLVSPKLHQNGRNLSLVVPGQYREDGNYPLIASFQNVLKVLNSKQRPRRIYINGSNGEIYKFLLKGHEDLRLDERVMQLLGFVNTILEKHSVPKRHDCLIQTYSVTPLSDNAGLVGWVDHCDTLNKIIEDYRVNPRCIRMELDLMRSMCDNLYYLTAIQRVEPFEFPLERTEGVDLVRSFWVKAPSAETWLERRTTYVCSLATMSMVGHILGLGDRHPSNLMIHAFSGRVVHIDFGDCFEVAQQRSIHPEKVPFRLTRMLVKAMEMGGIEGLFRHGCHTVMNVLREEGGSLLALLEAFVHDPLVSWWRDEAEGFSGNGQAASSVQTISVIGSMTNVAEEGSVGSLQLSQLSVQRRATTQQRVNANIEKDTSQTRKPKSVVKRIKRKLRGLEFPQSQEGKSSDGFTVEEQVSRLIEEATSNENLCVHFLGWCPFW

SEQ ID NO: 26672 - protein, 560 aa, Trypanosoma cruzi
MLSLLFFFFFSFPSVRIGGVGGGGRSHVTVLVLVAASLVLCRLLFCCHLCAFFLLSCFFFVRFLFFSLTLFLCRLCLFVFWWKCVRVRASETFRALSMSDVFYLNIPRGRVPRGVSGAASAAPTVSLHDPLSRAVSPASSNARWGVVPMVVGVLSVGCAFSLAVRLWQYRQQCLSSIMSGGGRVLRGEGGKPQLRRRPRRCSSLLHNARRDDTPLSQKEPLRLTTDESIPSPTAHLPEANDGCFDDDNRRNGLEWDSLDHQGEAGDEDFDTRTSSLNSPLMFVTTTGERYKRVSQLGRGGCGRVYKCFNLNTGQVVAVKEVRLEESTDGDRAEELRSEFELLSRVSHPNIIRVIGCHVGKQHARLFLEWAAGGSLCDVMKAIDRSFASGLHEDLVQSYVRQILEALQCLHENGIIHRDLKPQNLLIDHAGKLRVTDFGLSRLVAEGASAVETVVAGTPRYLAPEAISAGRFSCGSDLWAVGATMSELFTGRPPWSHLGVQQLPSLLYHIANNPEDHPVIPAHISEEAKEFMAQCFRPEPGDRGTAAILLQHPFLTGERRE

SEQ ID NO: 26673 - protein, 608 aa, Plasmodium falciparum
MNDLIIKNNKKGSCDVIIKYKCKKSDENIKRRKSSHKYIKNKSVVLGRSIMTNKKEKLKGALKYKGSKKEIKICNKKSMIKNDKDENTTLKSMKSDNFKFSRRGFILSFTGNLEDFYNLSKEPLGKGTYGCVYKATDKLLKISRAVKVVSKKKLKNIPRFRQEIDIMKNLDHPNVVKLLETFEDSNQIYLVMELCTGGELFDKIVKKGCFVETFASFIMKQIFSVLNYLHIRNICHRDIKPENFLFYDMTPESLIKIIDFGLASYFTHNNYEMKTKAGTPYYVAPQVLTGSYNYKCDMWSSGVLFYILLCGYPPFFGESDHEILSMVKKGKYQFKGKEWNNISEEAKDLIKRCLTMDADKRICASEALQHPWFKKKKYAFNMDMKMDIHVLENFKNYGLLLKFQKLAMTIIAQQSNDYDVEKLKSTFLVLDEDGKGYITKEQLKKGLEKDGLKLPYNFDLLLDQIDSDGSGKIDYTEFIAAALDRKQLSKKLIYCAFRVFDVDNDGEITTAELAHVIKKKYIYIYIYTYIYIHILYNGNKKGNITQRDVNRVKRMIRDVDKNNDGKVIIRKQKKKKEKKKKNIYIYIYIYICIFCFVLFRLIFMNFQK

SEQ ID NO: 26674 - protein, 166 aa, Plasmodium falciparum
MLKYQSKLCIHNILMYYFCIKFIRKIFLVKSIIALIKKKKKKEKKKKRKKKKKKKKKKEMADNITNDKRDIFKIHKWSAVAAWSWDISVDNCAICRNHIMDLCIECQAKTTDHENDKDKKIDKEGCTVAWGVCNHAFHLHCISRWIKARQVCPLDNTTWEFQKATD

SEQ ID NO: 26675 - protein, 947 aa, Plasmodium falciparum
MFMINYVFCEESNNMSKMVPDDDNNNYSSGKSCVYYQDLNKKEKEEYYRLNKKLRNDLFINSKQFYELHTFTERTVGFMRVQYFVYKLRDVVKCVEKETLLARSSSCLFMFNNIKRNDVHDDYVTKSSNGGVIKQLTERDVDDMYEYALNFCKQNKIVVVDTNTFFFDASKRKENLIKLEKVQTNEKDEYEEKDEVYRRGNNELSSLDHLDSKNNLIHMYYEKNKCDIINKDDENSTIATNNNDNNNDSSSYDKSITISRSSSCNNSHLSYSSFDNNHGNEKMKDYISVDENNNNNNNNKNNNVLLTLQRNSDDENGKDKDNEKNDVSLENNMEKNYKEEIWNYYTKNKVEVKTLEKVLNENIDTSVVCINLQKILAQYVRFKKNLPHVTPFYSVKSNNDEVVIKFLYGLNCNFDCASIGEISKVIKLLPNLSRDRIIFANTIKSINSLIYARKENINLCTFDNLDELKKIYKYHPKCSLILRINVDFKNYKSYMSSKYGANEYEWEEMLLYAKKHNLNIVGVSFHVGSNTKNLFDFCLAIKLCRDVFDMSSNMVFNFYIINLGGVYPEELEYDNVKKHDKIHYCTLSLQEIKKDIQKFLNEETFLKTKYGYYSFEKISLAINMSIDHYFSHMKDNLRVICEPGSYMVAASSTLAVKIIGKRRPTFQGIMLKDLKAHYGPLNFAQQENKKQDETKINHNNDNNDNNDNNDNNINNNNNNQKGGQGNIMNDLIITSTNDSTSKKYDHSSRKVIQNVSCTIRDKEVDNIKINTHTINNPNINGKENTVDGDNINIAHKNIGNNFSSSNSKLGNITNIKKKVVNINDNRYNYFSYYVSDSIYGCFSGIIFDEYNRCPIYVIKNKNNPNQNFMNFNLYLANVFGQSCDGLDMINSITYLPECYINDWLLYEYAGAYTFVSSSNFNGFKKCKKVYIFPESKPSLKGQPNKHW

SEQ ID NO: 26676 - protein, 311 aa, Plasmodium falciparum
MRNNLIVFICITLYLISSITCVFINKYVLMENTIDSVLLIFVQHISCLMFMFFFKDIFFLKKERDEKNIKESIFSLYNEIKELWPLIITFNFTLVFGNICLKYTSISFYQLARSMTLPFNFFFSYFFFKQIKFNLLMIISCIIVSIGFLIFSLDAVNTNYNSVLYGTIVSIIQAIHLNLIKKKLIIYKDKMVMLYYNLIYSSIILFIYLFITRDIFVLVHLDKRLTFYLILSCISSIFVTFSSFLCIHYTDNVVFNMFGNVKSTVQTFMSKYYNSENFNTHTIIGIILTTSGSCLYTCCSEYSKKRKITSK

SEQ ID NO: 26677 - protein, 1788 aa, Caenorhabditis elegans
MRTKESSEDIVGVGIAYNVPEENLISAIKLDEKASGGCYELTTKAAGDEYKMISSILSKTQAVEKVKGKMIQKVVAKDEIRVLETTTESVNANFNYEIPEENFKIGIAKTCANNAAPFTMRLHECLDFYVKMFYNMNKKDDFESLIKTIIISNGIESKTLSCTAAEHIEATRNPEFNRPAEFSDIQKTVVDYNKIEGASLNTFEALNEKMALSTMLSRQDDYSRVEHIVKDKNRGANLKFRFIESSEEKQTTFSAFEIDTEKEEIERTIDLVRQGGQFKLSTDAAEENEITLHRDISKPIITHYDTLHLITLSNSAPHQILSTSGASNELHTISTQLSKPAEWLNTELLIVDKNVEQPVTWRVLECEECVENLHPIYRRPDDIFDLDEIWHIARNGGKFERRCKASGDEKEIFEQEIKSRGIKDDIIDKKFIVGNQGEPTSFTTIQTSSVSASVSQDMSRLGEKEAIKKVLQNSNKGINVEKKMIEATEYRETISEQFRKNDEFDKADLTVKDRRAGGSYELSTNASEQSSSSVSNELICPRPSQLSIEKTFITAQTIIPAILSCKASESIGHTISEQWNRPNDQFAISQIVKDCNKENEQFTFREAGEEYHTTNCFYTREQEEKVIAKTLHEARKGSGQTFETKHATDRSMDASQHLEKDRLAEATAEKLFVIGNTAGPVSYSSKSSSDIQHSQVVNLSRPSPYVQVEIIRKGANLGTPTYFHARETTSKTENVATQLSRKEEKMEVSTTHTTPLLAEPVTFDSNASKSHSTSLDKNLVASEDYELDAVVIIVDNNTEQPQFFRCSCTKEASTSAAAALSAGSKSESCKIVRLASNLGHPTSLVLCESSSVQETNNVHYQRDEHHEHISETKSYPRDGGKFTLDTKASTANEVRIDKDLEKKSDRELETEIKTIVRNEGEPVEIFVSATEESAAGVTTSLSRANPFESANILLTSPNKGEPAYSRVTESSELTETNNVQLRREEEHQETEKIIEIAANGGSSLLRAGFADEKFADIEAKLGKDAQFESAQTIRQIGNEDKTNLSIGASQETSVTFDETVQCNKSSCEETSITKVAKNIEPHVIFRSTEASDMAVGIHYTLRSSEKVEETEEIKNIARNGGSATFSCFASGDESPDSVSAFLTRQPQEETTEKLFPTPMFDFIKFNSTAAEEFAVWNTTIFRRKDNEGEVEKIFNTSEAGHNETFSANAAEDVSVTLDADLHFGVGYKEHRQITKDEANQGEGTGMHSGASEETIFNLGYDYCKQPTEFTTVCVTEDKLLIQGAYGFRAAKEESITLDADLHFGVNYRDLLAMGLHASNNEIEGTGMRSTASEETIFNLAYDYCKQPTEFRTVFVSEDHQFVHGAFGFRAVGEEHIETQVLELQARMVEVMVEGSVHNLARRHEDEPFVLYTEVIEETIIRVDEQLEKKTTVIETEQASEVKMREKGEERRKEEKRVSFAAEVQEKTMEAIDKSLGLDTSMEVEPAFQKPSIIKKPMKKERERRSRDLRQNAAPAFKPVRRNSLLQALAIGSPHNIPHFKTLDDIVKAIKHAGLEYSNLIFGIDYTKSNFYQGERTFDKRPLHTIDPAEMNPYQQVIQIVGKTLSSFDADGQIPAYGFGDEEFTDHGIFNIAERYDLEKDCNGFEEVLRVYNEVTPTIEMSGPTNFVPLIDRAIEICKEKHSYHILVIVADGQVTNEKINQKAIAAASHYPLSIIMVGVGDGPWNMMGRFDDNIPKRLFDNFHFVDFHKVMFNAPNADASFALNALMEIPDQYKAIKELGLLKHSRRG

SEQ ID NO: 26678 - protein, 2697 aa, Caenorhabditis elegans
MLQQHGISFQMNADRQNKAATTSNRIVSAPATNEFDERHRKQGIDAARALASQYRSRITENRDANQRQAARELSRYVRSELKDEPNTFSDAFLNAIDGRTDIASQSAIYNCMKSNSNIDQKRAGIYLIVCLAETHSGNVIRYANYLLKMLNNGNGLDEDTVKMASKALAFLIATCKSYAAELVDRCLDHCHEWLGQNVPHSQQPKNQQEIDQIRRLAASHLSRELALATPTAFFLRVNLFFKYIFNAVRDKNPAVRIAGIDALHVVLTIVSQREAKNKTEWFKKCFDEALEGQPNPSQKDDLDRWHAVALILNELLRISDQRFELIRCESSQFIKQKFLKEDEEEGVEWLVLTKQQTIVESVTARKLVLERFPKILDCVRQIIPLANKTSSTKQQSSIYLNTVLMQLLPRICAFPQCDRTFQTISFDTSFTILQRNAVAAPAIGMMMLSNPDVHATHIEKTISFISAAIKKTTNSDVLDNYFTFLFLFVDAYHEQVTTQIKAIIPQLMDITLSRSLANVLKMIMMRIPKLRLNVQDGVMASVYQTLTGSLIPPKSEPIGRPASPKAILQKAETDPKELQRIVLAVDVLGEFYFSRGALQRIMQYVADYYLTADNVEIRLAAVSSCCEMVVPFVGVYKKVTSDKRNSLLQTIYGVLRAVCSVIVNDQDVRVRMQVISCFGQMPRPFLAHLAQPEMLEVQFMALHDEKLEMQQACVTLLGRLAELNPALVLPRLRLMLLETLSQMQQSGQARLEQHSAKMIAQLAKQSPKFMRPYVGSLMIAMIPKLRNDQKYAEVTAQVLNAVSEIAVIGGAEIVKNLKPLFEKLTHMINDSSSLHKREAALRAIGGICRSTAYVVDPYRDYPSLLDDLLRILKTVMSNTMRREAIKTLGILGAIDPYTHKVFTGSVQSSTAISTALSLPISETDSKDPRQDIIHWFNYEKCTLEEFYPAITIANLMLMMQDEDSQSYAEIAQAIVTIFRSLGDMAPLYTEQVIPRLIEVCRRATESSNRANLREFFLQQLANFVAIIRKHAAPYMPAIFTIIADAWKEDISVKMVVIEVLTDMGTAIGNDFSKYTGELIPYLLTVLQTDKTKERVLTVKVMESIQKLTHCIVQHLHLVLPPLLIILDDFSLKLSIRNTALSTVLHMTQQVDVSAYAPRMMQSWHHNISTAEMRDKLLLLLIEIIKQLGKFFDIFKRGVDQKLRDYNLDKSVHYEQYRKLAQRAQMSRDVLTSSVFAGSNGNIQYSSTQAGMRGQANNVYANNDLHERLMNGSIDSGASRQDNRDDYYRYGVEEKKEVPKVAPTTARPTSELVTVQITKQRLNKDALMPQWKNENLTSKDEWLQWLMKIRIGFLTYGSSPSLRAASSLGDQHPHLARDLFPAAFMSVWTELDSDVQNDLTSCLLRAISTGIPELIQTILNLAEFMDHSEKGPLPISHDVLGRWAEQTKAFAKACRYKEMSVLKKSGSMQTTFTRKVKLEPNDCQSLITYANKLNVQEEAAGVVRYAERNEMNFQMRGRWYEKLNEWEKALGAYELEEKKKSSCPNLQVYDEKDHLMTPEEAATAEEARMHEMRCLEALGRWDELNSKSVVWADQRGNRNDSVRDEINKKQLDHKMAVIAARGAWAVDNWERMADYVSVISENTQDGAMLRAVVAVHNDENTKAMGLIEKVREMIDSELTAMANESYERAYIPMVSVQQMAELEEAIEYKTRPERRPRIALLWSRRLQGCRRNVEQWQRLIMLRGLVLSPQEMHPLRVKFSSMCRKQGKNSMSRAVLRELLSLPANSDLVRAKAPFDKPLLVLALAKQLYQDDHKDEAIRALEDLANHWNKRINPIPKATGRELIPPSTKEPARICAKVLLKLGEWTELKSKTSNNMQVGELSFVRQQVSPQYRTKESRTPETIAFENTINYYQQATQYDPGWHKVWHKLASTHFYAVCRERPHPTTVISPPQQPQQPKKMHIPPVTRATSPPPPAQKSPQPAPFHSITEPLSVIIDYPVPPPLGSLVGLPPMPAYLSSNSSLPPQHHHVSPLSNDSPSNSAENKLYLKHAAHAVRCFAKALMCSPGSRLEDTLRLMQLWFDHGDDKDQDVYFALTETIFDLPVTTWLEAIPQLMARLDCPDDQKSVQLVLRVLCEIARHRPQAVIYALTVASRSKDVHRSKNAGTVLEKMMEYHSKLVREASLVTEELVRCAILWHEQWHDALDDASRVYFHRRLQDNNVQAMFDALRNMNDLMQKGAPTTMKEHSFQQTYSSDLKEAGRYVQAFESSGNVKDLNQAWEIYCSVFKKLRDQLATLNSLDLVYVSPNLVSAKDLELVVPGTYDPSAPIVSIQSFSSKMNVITSKQRPRKMVIRGSNGLDYQFLLKGHEDPRQDERVMQLFGLVNTLLANNSETCRRNLTIQRYSIVALSKDSGLIGWVPNCDTLHTLVKEYREKKAKIPLSIEHKTLQKLSLETEHLTLMQKLQLFESALSVTQGEDLRHVLWLKSPSSEVWFDRRTNYTRSVACMSMVGYILGLGDRHPSNLMLDRLTGKVVHIDFGDCFEVAMLREKFPERVPFRLTRMLINAMEVTGLDGVYNYTAERVLKMLRTNQESLLAVLEAFVYDPVINWRLVEGMKKDPKTRKDTGGRQNMAGAVLPSSSTTDSIMETIKRKLDGTEFVHTDGSTPPEPLQVTEQLAMLTEQATSPLNLCQSYIGWCPFW

SEQ ID NO: 26679 - protein, 829 aa, Caenorhabditis elegans
MRTIPTVNTTSNNGSNRSARSSLDTPSPSAGDQRAHPEVEQPVSSSSPATPSISGPPPCATSSGSTSSITITTTGCSTSSSGPSKHILGGEMPAKENDEAHPELKQNFIAKNLKGFGFSKKQPVLTKEEEERIFAEYHYTGATTNIHPLLSSLVNYTHPVKFSGFDVAEANNLHFHMSSFSESTGLGYLKQSAPEFVNYNKRQSSRIYPKGARVDSSNFLPQIFWNAGCQMVSLNFQTPDVYMQLNMGKFEYNGGSGYLLKPDFLRRPDRTFDPFSESPVDGVIAAHCSVRVISGQFLSDRKIGTYVEVEMYGLPTDTIRKEHKTKVIPGNGLNPVYNEDPFVFRKVVLPELAVLRFAVYDENGKQLGQRILPLDGLQAGYRHISLRSDTNQSFILSPVLFVQIVIKTYVPDELSGLVDALADPRAFLSEQKKRQEALAHMGVDDSDIPDVPNTRNMALRHVKQPPRQNGSSADLLANNGQTGSARGDQTSSMASSTIRSPNEQPQPVAVDKFKVDPIEVDDLRRDKAFAKLLKRFQKELDDLRKKHQKQRDSIQKQQQTNVDKLITNNRRSTKKEKGSRRSLTASVSSGCGSASGTVTVSVCSPSGASCSGYSTGGPSTPVACNSDGTGSPATIGSPVPQDLVNNDRVRSLVNTQTGEWSAMVRRHDEEEFELKKVQLKEQFDLLRKLMSEAQKNQMLALKLRLEAEGKDLKQTQTKKSMEDAKVIQLDKGIKTKAERDRRVKELNEKNLKMFVEERKRLAMKAQKHEEQLTKRHLDQLEQLDKDFHKALDAEIHANNFLNIPPRKIDKSIAFFSKEYLIQLLNRKTP

SEQ ID NO: 26680 - protein, 525 aa, Caenorhabditis elegans
MAKEFQFNWKPTIIPELLHGSVFDRYDDESTCLELNAQVRIDENGFFLRWLIEGKDAVVLDMGQIWEARTGGLPKDGRIMFELEQRGASETIAERTIWITHGQDLVNVQSFFLVAESVELAKTCRAGINDILKSSRIRHVCPTTQLMKYHTWLTMNVNERRKIPIKLIIKTFSSGKPEKMVQKCLNDLGLGGDKEREELDVDILTFEKFQRLYNKICPRTEVQELFVKLSGQKEYLTKERLINFLNEEQRDPRLNEILFPFFDSQRIVALLKKHENDIKYQEDGKMSGDGFLRFLMSDENPPVFLDRIEMFMDMDQPLCHYYINSSHNTYLTGRQYGGKSSSEIYRQVLLSGCRCIELDCWDGTGENKGEPIITHGKAMCTDVFFKDVLVQIRDTAFARSDFPVVLSFENHCSKSNQLKMAKYCMDIFGDMLLSKPFEDAPLDPGVSLPSPNRLRKKILIKNKRLKTDIERHQLDQFLREGKLDEEDELNETPEVVGEDSVSPHFTISNSNLSILNYQAMFKKKY

SEQ ID NO: 26681 - protein, 460 aa, Caenorhabditis elegans
MNITGRIDKIQEKSLKQRNFVHKTRTEAKLLTVSENFATVLSNVDGHSIWLVPSSSGRDDDAVSLDSCQSVYSPVRHHINSGTGGGILMEPSSIHVPENYYSVTIGEAQMVVLKRYQNLRLIGSGAQGIVCSAFDTVRNEQVAIKKLSRPFQNVTHAKRAYRELKLMSLVNHKNIIGILNCFTPQKKLDEFNDLYIVMELMDANLCQVIQMDLDHERLSYLLYQMLCGIRHLHSAGIIHRDLKPSNIVVRSDCTLKILDFGLARTAIEAFMMTPYVVTRYYRAPEVILGMGYKENVDVWSIGCIFGELIRGRVLFPGGDHIDQWTRIIEQLGTPDRSFLERLQPTVRNYVENRPRYQATPFEVLFSDNMFPMTADSSRLTGAQARDLLSRMLVIDPERRISVDDALRHPYVNVWFDEIEVYAPPPLPYDHNMDVEQNVDSWREHIFRELTDYARTHDIYS

SEQ ID NO: 26682 - protein, 366 aa, Caenorhabditis elegans
MALRKCGNLFVARLAGTSTRAASTMTVRDALNQAMDEEIKRDDRVFLMGEEVAQYDGAYKISKGLWKKHGDKRVVDTPITEMGFAEKTENSSKKITFFSGIAVGAAFAGLRPICEFMTFNFSMQAIDQIINSAAKTYYMSAGRVPVPIVFRGPNGAAAGVAAQHSQDFSAWYAHCPGLKVVCPYSAEDAKGLLKAAIRDDNPVVFLENEILYGQSFPVGDEVLSDDFVVPIGKAKIERAGDHVTIVSYSRGVEFSLEAAKQLEAIGVSAEVINLRSLRPFDFESIRQSVHKTHHLVSVETGWPFAGIGSEIAAQVMESDVFDQLDAPLLRVTGVDVPMPYTQTLEAAALPTAEHVVKAVKKSLNIA

SEQ ID NO: 26683 - protein, 367 aa, Caenorhabditis elegans
MSARTTLYRAPNYYSTNIIEHKTYSISKNTVNKSKMAAPAESHARLDGRFWLEGTPYLAEENVGAGAYGVVCKAMDTRNKKQVAIKKIPRAFTAHTLAKRSLREVRILRELLHENIIAVLDMFTAEGAHGKDIYLVMDLMETDLHQILHSRQTLMEQHFQYFFYQLLRGLKYLHSAGIIHRDLKPSNLLLNGDCLLRIADFGMARAYASASTVRDDANVGGHMTQYVSTRWYRAPEILFSMVEYDTKVDLWSAGCIFAEMLLRRQLFPGKDSVSQIKMIVYYLGSPEEEVINRITSDLVRDSIEACGRKTPLPFSAIFPKASPEARNMVSYLLQISPWKRYSADQILQHPFMAQYHNDQYEPLCPPR

SEQ ID NO: 26684 - protein, 786 aa, Caenorhabditis elegans
MGASHLHDDPRPGSPVDHQPTTWGGIIKKWPKQTFLIVGNELCERFSFYGMRAVLTLYFFNILNFSQSFSTVLFHAFTVICYSSPLLGSILADGYIGKFWTIFFISIFYACGQILLAFSSIAPSGSSHHPLLDLLGLLIVGLGTGGIKPCVSAFGGDQFPAHYTRMISLFFSMFYFSINAGSLISMWLTPYFRSMSCFGHDSCYPLAFGIPAILMIVATLVFMAGSFWYKKVPPKENIIFKVIGTITTALRKKASSSSTHQRSHWLEYSLDGHDCALSTECKNLHGNCAQRRYIEDIKRLFRVIVMMIPVPMFWALYDQQGSTWVLQAVGMDAKVFGFEILPDQMGVLNAFLILFFIPIFQSIVYPTIEKLGFQMTMLRKMAGGGILTAVSFFVCGIVQLFVNPTLPYIPMANEAHLTIINTIPSCDFNVLIDSREPFDLLRKSVGIAPDDSVRKPISFTGDDFFQPNITFDNLAPNCPKFTAEPMLAPATSYVLTLSPNGWAYNAVRPEKPKSGKGELSMGLNLIVPCDKIPSNVTWEQCNGTEGYSGAIALCKVESDVITDNNNVCDPTAKGKFYVLSNANPLDVHDFSKKSTVTAFGRTYSPIEMKPGTYRLFYTDDSRTHFTPLNLPPVQQDHMGGQYLITVSTRSKNDSEVLATTESLVSYNRVSILWQIPQYVILTAGEVLFSITGLEFAYTEASPQLKSVVQALWLFTTAIGDLIVVVIFMLNIFSDVAVQMFVFGGIMLFVIFVFILLAVFYYEYADYSNESEVLTEKMIVDDDHTRI

SEQ ID NO: 26685 - protein, 440 aa, Caenorhabditis elegans
MLIFQLPAEYSPSASSAPYFNYSPDDFILDLRSHQSDEIYENGNSNHEKDEKKALKELLHERWENAKQYNAFNYPLNCMYRCLDGKYDLSMQLNIERGELRRKPMHFKNIKEPFNHLRFNFAKLHDHEILFYLKCDTDPISNDLLDRHLVAVNASPLERDHSLIVPSVNKCSPQVLTLQAVRIAVDLMLLVDDDMFHILFNSLLGQASVNHLHLHAMYWPYDSDLINRKCEPLHDVPNVYVIRPPVWICPAIVFQLDSLDNYEQFKMNIYKCVEHLTESNQAHNLFLARAQPIRTTGAEKEEDRRGERPQLVTCYVFPRMNMIGAKPPSNFNPAANELAGNLTSYTIRFFESANEQSVIRIIEEEASLDDDTFRSLCFDLADVLIGRSVGTSRPQDLDTLAGLTSPEIDELRDSFQSFMPRSPSIRHRSSTRAQSDEGSK

SEQ ID NO: 26686 - protein, 422 aa, Caenorhabditis elegans
MLEFSQKLAAGTPGPHSSTHNIESSAFATADITLGFLLCGRLSFTTQVNNRVNVCGGTEMSAADMARKNSLINRQLEKEKIDSKKMLKILLLGGPECGKSTIFKQMKIIHMNGFSDLDYVNFRYLIYSNIMQSMDQLLEAAEFFHFPPDDSPSIRRALNHYKSYKVRYSTSEVELNRELADSLSKLYNAEFIKSVLNRKNELKLLDSAVYFLDDIDRISAHEYKPTEMDVLRARVPTTGITEIEFPFKQASLRMVDVGGQRSEQRKWIHCFDNVNGVLFIAAISGYNLYDEDEENRKDDGTPTKTNRLRYSMELFKRIANHQCFSKKTAMILFLNKIDIFKEKIGKYPLTTCFKNYKGVNAFEPACKYVTDRFSRLVSGDIQHEKPLYTHITNATDTRNIDRVFDSCMDVIFKISMEKVGFM

SEQ ID NO: 26687 - protein, 570 aa, Caenorhabditis elegans
MAGRKSSRTAERVPTTQKPERKSAILSPHDELRERLLETAIDMKENIPQRNTRNSSVGSQKSDCSETRKRRSTKNTVLCPLCMSNTCLPSESHCSSGGIAQWQSIRLQIERSLVQLREGPAAKRHSGEKHRNGSREDSLEYISEYSDDREVGSSSSQSSRTRGQPLPAMPEEEEVFDKSSSSDNLAESEESHEMVRLEERQDIEEEIEDDFDDEEEDVVNDKEEYEEIESEDEDDYPVQNEGFAVTKRLMNDEHMVTAPTFLSTAKCDGIGSPTKVWSLMVKRDEIPRATRFLLGNHPDMDDEKRRILIDWMMEVCESEKLHRETFHLAVDYVDRYLESSNVECSTDNFQLVGTAALFIAAKYEEIYPPKCIDFAHLTDSAFTCDNIRTMEVLIVKYIGWSLGPITSIQWLSTYLQLLGTGKKNKSDHYEEQNMYVPELLRSEYLEMCKILDFLLFEIDSFTFSYRTIAAAVLFVNYEPTCAVEKATGFMQAQLEKVIEYVEPVCRAFAKQRQLLDDVIPKHESIKSDDSHNIQVYVKRSSMEPIVVEKRTREDSAFKSSPSSSATTFLK

SEQ ID NO: 26688 - protein, 1663 aa, Caenorhabditis elegans
MSTVYQMSQERQQKTITSTSFGAEEFIIITNFLLKQATPTTFKKGQNSWMDEVLETFTQGCRTLEKPDSYVPETFIEKWDWIINQTANFCIVNKMKTPLGKPMQTFAAFENEIKRLAKEVIVRKNSDKKLNKSSTEDPNQSPPLKYSVQWLRVHLLLKLIVVLEKLMNSAIHGGSSVFNLTEIPVSSRQFFTVNAASCEVWLNRVYYPALLVAYFNGYYGLVIRFGSNALSHFARQKDGDNDKKIVNGVCTASLMSLSMAVLGEPMEIVGLRRKVREEFGTDMGQSLMEALGEMANARYETALVALEAVLVTDAATNETLKMIIQLAMVDILNRIRLPQATDYYKVVLFGEESNDSTITEDFRSVELLTKFEKLNNTVNEKRQVVDWSARERFQFVESAFSQTMRRRVSRVTELLDIQKDFSAMGALALSADSSCKLYSDISSTSLIIANLVNKMTGVSQWKNKLTDTEIFDRNEEGNDGDKLAICRKLMHWGRHTKSNRGQSCAAHSEIIRLSRKTSNCELAFFHINSAIRGEKLAAWQRLEVERQRLKLVKTQNLDVRIREMNEVFGSLAEVFTTSCQLKSDFQMVDGMIKEKMISEGYNEDIAKREEHMSRASIQLADFFQSLPELENVLAPNLFPTIIWSELQRRSDSLSAGYHGIVGSLFHLASEMCPSLAKAHLKMARWAYEIAKIKNFPAENLSFYKFGKDETENEELLKSLEATSLVNLEKLVRAAISDDLRANNILAPNSHFMHIWKMVRDHRTKFLSIAVTSYFQFIQNMSGDCDNLPYSKKEETTLATLRILELLVKHGDVLIDVINDGLNKTNVHIWKEILPQLFARLSHPSEHIRKTLVDLISKICTAAPHAVVFQVVSGAASSSTDGEELEEQQNDDRNRVRACCEKLETNMSQSYPNLVKDVRQFVAELERINLLNEEKWSVVMGTMEHEMEKRLSLIRTENAKTESALHLTASVKNDIIVKRTQLLTRQIFDVLDELYQQTVIEPPKSKNEEEFVTAFAEVLTNAFQESRISRTTSPEKSWIPFKNLIANFVHRNSKKGMQTFETEDISPYLASLSNSCVPMPGQESVEFDRVVSISRVARQVTILPTKTRPKKLGFVGSDGKQVAFLFKGREDLHLDERVMQFLRLCNVMLQPGKGKHRQSVAAYQAHHYAVIPLGPRSGLIKWVEGATPMFHIYRKWQMKEKALKQATKKNGETVPEIERPSNMYHNMIRLAFADHKIDSSITSDRSKWPAEILEEVFESLTAKTPTDLISRELWMRANDATTWWSVTKRYSRSLAVMSMVGSVLGLGDRHLDNLLVDLKWGHVVHIDYNICFDKGKNLRIPETVPFRLTRNMRHALGPSEMYGTFRESCVHVLSTLRSGHQVLTMLLDAFVFDPLVDWTSHEHTATSGVSLALQLAVYGSNWKTKAKERLTDAMELLNLRMSEVQTLWLANRDDLLHWMKQVTECLLIENSMLGANAIYAQQRVKAGTELREAVTRHHALAKELRPLIRVIGKEREEFADYLKFYKQALFDPLLKGHSALRNELDIDTCVYNFNIVMQNIDNVFGALVNLSFTPIETITSRTSQQEFKPPPGLENVWVVKQDQQENSQAREVVRRVERRLNGWLDGSAGPDRKLSPREEADILIAEATSTPNLSQMYEGWTAWV

SEQ ID NO: 26689 - protein, 416 aa, Caenorhabditis elegans
MYQSAASARYTNSAQRAVEVQVFSHKQKMAVRINKLIFILKTPLSNVFRKHEELSKMRYLINALFEAMRNRENPTKWESYKQVITAVSAYWVFSIGLVFLNKYLLSSVQLDAPLFITWYQCLVTVFLCLFLSKTSKAYGLFKFPSMPIDAKISREVLPLSVVFVAMISFNNLCLKYVGVSFYYVGRSLTTVFNVVCTYLILGQKTSGQAIGCCALIIFGFLLGVDQEGVTGTLSYTGVIFGVLASLSVALNAIYTRKVLSSVGDCLWRLTMYNNLNALVLFLPLMLFNGEFGAVFYFDKLFDTTFWILMTLGGVFGFMMGYVTGWQIQATSPLTHNISGTAKAAAQTVMAVVWYSELKTLLWWTSNFVVLFGSGMYTYVQKRVMDKKNSGASPASEAKSDKVKLLGRDGNAAEESV

SEQ ID NO: 26690 - protein, 651 aa, Caenorhabditis elegans
MEVRDYGLAELFHWNWDHIHKVYVITTWLLVASLAKILFNLMKPLSKWLPDSSLLIIVGLGLGYFLNQTTLSGVHLDSHAFFLYLLPPIIFDAGYFMPNRALFKNFDSVLVFSVLGTLWNTFAIGGSLLIMSKYQLFTMPFTTFEILVFSALISAVDPVAVIAIFEEIHVNEFLFINVFGEALFNDGVTVVLYQMFKSFALIGSENLSPWDYATGGLSFFVVALGGAAIGIIFAIATSLATKYTQGIKILAPVFIFLLPYMAYLTAEMVSLSSIIAIAVCGMLMKQYIKGNITEAATNSVKYFTKMLAQCSETVIFMFLGLSTLTSEHHVDFIFIGATLVFCLIYRAIGIIVQCFILNKFRAKKFEVVDQFILSYGGLRGAIAYGLVVSIPASIQAKPMFITTTICVIYFTVFLQGITIRPLVNCLNVKKKEHREATMVESVYNKYLDYMMSGVEDIAGQRGHYSFIENFERFNAKVIKPVLMRHEKRQSFDATSIIRAYEKITLEDAIKLTKVKSTLQNKRLEKVKSEVRVAPEQTTVTPKDVQLARFMQSGENIDQLYTLFSDLLDKKLNELKVQADKVDKANDDDIQDDYMAEMGSHSNLGFMHHSADQLDSDSVFQRRGRRLSTGDLKGHCGTSRKPKHSMFELRHV

SEQ ID NO: 26691 - protein, 453 aa, Caenorhabditis elegans
MSNDQLKSKLREFFDRQPDQSEKAHQDSKIFEVLYSQFLENQHLIKLNGGLGTTMGCSKAKSLVEVREGYTFMDLAVLEHQPTFWQIDNFFWKNLNFEGNQEQCRNPRKMCEAHNVDTPLYLMNSFYTDEDTKKYLAEKGYSNVKTFVQSKCPRLDAETKLPIEDENEDWGDDAWCPPGHGNIFQSLQNSGVLDQLLADGREIIFVSNIDNTGANTDLQIVQLMLDKNVDYIMECTPKTQVDVKGGTLIDIGGRMMHLEMPQVPAENLPDFCSTKVFKIFNTNNIYVNLKAVKKLLPDIKSEIIVNKKTIRSREVLQLEFSIGGCIKNFDNALCVHVERKRFRPVKNLGDLLSLRSTLCDLDHSTFKVHHNHELGAPPVISLDPSIYNSVEVVDLKFPHPLVMDNCSEFAVVGDVTFGKNVKLSGKVTVNGKTESPGVVPDGTVLKDQEYIAE

SEQ ID NO: 26692 - protein, 691 aa, Caenorhabditis elegans
MLKTRSTVTLYRAPDYYSKNVFLEEQSGSKSCSNDLFCLEATQYLAQENLGAGAFGVVCRAIDSKLNKQVAIKKITRVFKNQSTAKCALREIRITRELSHENIINSTDVLMRESGSGQDIYIVMDLMETDLLSVLKSNQTLNEKHFQYFFYQILKGLKYLHSAGIIHRDLKPANLLLNEDCSLKIADFGMSRSGPSTKTTPNTSPNAHISGDLSQYVSTLWYRAPEILLSMGEYDTQVDIWSAGCILAEMLLLRPIFTGTDSYSQIQLLIEYLGTPDEQVIRRIKSPSIRDYISSFGPKTPLPFTAMFPNASIEARNIVSKMLQISPWKRFSAEQLLEEPFVKHWHTVKNEPSCPNHIRQNLLETAKYEGDVIIKGLQEEIDDIPMGRCEQDKKNAEDNSEVGSYNCPSNRDHRDSSRRAHHPNEIYVSPTVMMVMRHSERVDDCCPGWIEKCNKEGKYEPFDLNMPTRLPIQRPLKDYTRDTCITRSGAVLAQMIGRGLLMTDNTPDVIYCSPSLRCIQTATWVREMSGSKALLRVEPGLFENFHYPHGVPRFISQLQRHVFPVDKTFRPFLSLETVVGKQETNDEYNARIQLILNAIADQSEVSTVEKELKVLVVAHASTVDMAVGLLREVPRKIREEELDNIAIPVPYCSLAYLKKKCNYWVPAAHQVPSVTYEFLTTKYNHYFVHRT

SEQ ID NO: 26693 - protein, 425 aa, Caenorhabditis elegans
MLEDKQKQKRHQSAGSVRTTSTAMSMNSMKDYPTFDNSLPFSISDNSSVSVSMNTPLIPTQDPIAQPRMQSMPRQQPQQVQESLISIGDYPDNDINAKLSKVNLTSCVVSDDEDEDKRSYADSPWNTDVVADRIPSEVLPDYNFIKNNLAKFVEDPAVEHCLYKCSITRQKSGVDKGMFPTYFLHLEEFDTDKRQKIFLLAARKRKKSTTANYLLSTDPTNLSREGEGYCAKVRSNALGTQFTVYDSGQNPKKTTNHAAIRQELAAVIYETNVLGFKGPRKMTIVMPGIEPPTENRPAVRCPVRPIQDKHTLLERYRLNDLDSLKILSNKSPQWNDETQSYVLNFHGRVTQASVKNFQIIHQSSPEYIVMQFGRISDDEFTMDFRYPLSAVQAFGIAMTSFHGKLAYNPGKSWVQERQKCPGIFQ

SEQ ID NO: 26694 - protein, 334 aa, Caenorhabditis elegans
MSDVPDDANAGCPGTGSAGAGKASGCAGCPNQGSCATGQGPPPDADVPKIQDRFSRIKHKILILSGKGGVGKSTLTSNLARALASDPSKQVAILDVDICGPSQPRMMGVEDEEVHNSADGWTPVGIQPNLTLMSIAFLLGDKNDAVIWRGARKNGMIKQFLKDVDWGEVDYLLIDTPPGTSDEHISLVQFLLQAGPLDGALIVSTPQEVSLLDVRKEASLNLKLSLKKSFQNKFLILTVSFCVKTKVPILGVVENMARFVCPNCAHTTLLFPTSTGGAEQMCKDSNLELLAQLPLEPALAKALDNGEDFFETNPDSTLAKSFLDLAEKVKAKLV

SEQ ID NO: 26695 - protein, 2783 aa, Caenorhabditis elegans
MVRQIEKTVLNTVLTINSIDSQDQGEFALKIKNRCGEDKYAIGIQVTDRPAAPGKPAVEDQNVDSVRLRWAAPTNDGGSPVRNYTVEMCTEKGKTWTKAEVTKQAFITLFNLVPGESYRFRVRADNTFGQSEPSDESELVVVKNVSRVVEEPKKKEVKVKEQESVDYERVAKDSEPSEYKTIDIHRLPNDLQAKYIIHEELGKGAYGTVYRATEKATGKTWAAKMVQVRPGVKKENVIHEISMMNQLHHEKLLNLHEAFDMGNEMWLIEEFVSGGELFEKILEDDSLMSEEEVRDYMHQILLGVSHMHKNQIVHLDLKPENILLKAKNSNELKIIDFGLARKLDPKKSVKLLFGTPEFCAPEVVNYQPVGLSTDMWTVGVISYVLLSGLSPFLGDSDEDTLANVSASDWDFDDPSWDDVSDLAKDFICRLMIKDKRKRMSVQDALRHPWITKMQPKLDKSGVPARQKRNFLSLKRWSDDLLPIGRLAKRGAIFRRLTMDGVFERNIAFDTDAAPSVKKQLEDIVANVGDLIATLSCDVDGVPSPKVQWYKDDKELTVPSMKYDSFYNEGLAELTVKNIVESDAGKYTCRATNDLGSIMTHAKLSVKADEKKKKKSKTSPAVIEKKKDRKTSKVVVIEEMIDMPPNFHHLLQDDEAKIGEPKILVVTNTTLPEPTVDWYHNGEHISINDSNYLRKHDKGRYELHILSVDSTDEGKWKAVGKNAFGECESEAKLTVVIPDGQYAPSFGKQLSDVKCSESDILKLEVNIQANPAPEINWFRNESEIEHSQHHRLQFDDGSGNYSLTIIDAYAEDSGEYKCVAKNKIGKAHTVCCVRIEELLSKRSKKIDGSKAPRFRMQLPTPREVPQGADLTLVCSVSGTPHPNIKWTKDDKPIDMSNKQVRHENGVCTLHIIGARDDDQGRYVCEAENIHGVAQSFSVVEIKEAVDKDHVRPKFLEPLVNCSTCEGNEMVLECCVTGKPIPTITWYKDGLKLIIENRMLQYTDRKGVSRLNIMNVVMNDDGEYTCEAVNSLGKDFTHCTVKVVDMGLSKTRLTPVRSRSRSRSRSPSVVGGEIQRPPVVTRPLADATVTEGNRELLEVEVDGFPTPTIEWYHDGKLVAESRTLRTYFDGRVAFLKIYEAHEEHNGQYVCKVSNKLGAVETRAIVVVEAPDAAEHVTQMPTFVKKLQDVVLKTAGETATFTCQSYANPAAQVVWLHNGKALQQTKSNYKTRLFDDNTATLVIENVTDELCGTYTAVANNQFGDVHTSAQLTISGSEAKKIAASLPYFIIELKPKINVVEGATLSIQADLNGSPIPEVVWLKDNSELVESDRIQMKCDGVNYQLLVRDVGLEDEGTYTITAENEKGKIRQNTEVSVTKSKEVKEKKEKKKVEKKDEGKKKPGRPGLPRPSGASKTEQVTMAFDAPSEGPADSYEVERRCPDQREWVSCGSTKSLELEIKGLTPNTEYIFRVAGKNKQGLGEWSEMTSTLKTASVGQAPQFTISPQSKIIANRDDEFEIAVEFSGTPTPSVKWYKENLQIVPDEKIDVATTSTSSILNLKSQEENGTFNCLIENELGQASASCQVTIFNKPASLQSTPDHSLERNLVPTLQKALNNESAQAGQQIMLTCRISSRSESTVAWFKDDERIESAGRYELSSDKKSNHKLVCHAVQSQDTGKYRCVVTNKYGYAESECNVAVEDVTKFIAPSFSATLSDSTAILGHNITLECKVEGSPAPEVSWTKDGERISTTRRIRQTQDENGNCKLSISKAESDDMGVYVCSATSVAGVDSTSSMVMIAKTTGTDSHLVIAQTADEKHEKPRFTRAPPSLIEVNESGQFTLIAKAVGEPKPTVTWLKDGREILRTNRIYHHFVTGDGESHLIAECVVSKTSGIFSCKAENPNGTVIAETQVIVQRMKPANQLANVAPKFTIPLTDMGIVNGHPTTLSCNVTGSPEPTLEWIYIDDSGHKINLTSSTTDWTECRFGKVAELKSERVLREQRGTYQCIATNSSGQATTQCYLLVGELSDEPAGPPRFVKCLQDTWTPLKESIEFSVELAGFPTPDLTWYHNEKKINEGKDVKITFPSDTTSVLSIKNVSLASLGMYFVEASNIHGVLRTAGRLNVSDERRKAEPPQFKHVLEPVLAVQPKVAFSEEHPRASSSAATARVKKGAAPMFLQGLEDMDLKAGASAAVAGKLGRKLRPHRSTTNDADKLAKALAQSLRLDEPRASIDSRPESAANAALDEVRAAINSRNKRVCRPKFMVKPKPRKVLEEYKSLRLKTAISGNPMPQVHWDKEGIILETGNKYSIYNDGDFYYLEVHHVSTFDKGFYNCTAANNEGIITCTSEIDVLPNKEDSAAQVAKRKSRKEAKAPNFIEVLPGRSQANLNESLCVECSVSAYPCASIIWTRNSVRLLPQADRYTMSYDGECASLKFISVTPGDEGTYACEAVNELGSAVTNMNLQVSGVDPNAAEGIPPLFRFEKIKSVRKVVDGSRVELAAELVQASEPLQIRWLRNKVTIVDSPSFSYSRSENMVFLTIADVFPEDGGEYTVEAKNQSGIARCTMQLDVRNNERSVADEAPRVFDFEPTTRSDPGVSVELRAKVIGHPDPMRNEGDKFILRIANVTRADAGKYELTAINPSGQANAELELTVVQSTKTVGAKPKFNESPISVQTCEKNRAELRASFSGTPAPACRWFYNGNELIDGLDGYTITSSDTNSSLLINSVDKKHFGEYLCTIRNQNGEELANAMILSEGECRKHPRIDIVFVCNSFIFSVVHVLLISISRGVR

SEQ ID NO: 26696 - protein, 887 aa, Caenorhabditis elegans
MSENIVSTRPVAQAQYCGPYKLEKTLGKGQTGLVKTGTHCITGRKVAIKIVNKEKLSESVLQKVEREIAIMKLIEHPHVLHLYDVYENKKYLYLLLEHVSGGELFDYLVRKGRLMSKEARKFFRQIISALDFCHAHNICHRDLKPENLLLDERNNIKVADFGMASLQVEGSMLETSCGSPHYACPEVIRGEKYDGRKADVWSCGVILYALLVGALPFDDDNLRNLLEKVKRGVFHIPHFVPADVQSLLRAMIEVDPGKRYSLADVFKHPWVSGTTKADPELELPMSQVVQTHVIPGEDSIDPDVLRHMNCLGCFKDKQKLINELLSPKHNTEKMVYFLLLDRKRRRPAQEDDTEIVLRGAAQNNDPPKKRTDSSRTSRYPMGSIADGSPINPRKTYGRNQKSGRHSSLGGSPTESPRSSTRDLFGSSSSGSYSARAGEDRDRGRSASRSTNSYHYYTQPVDPQTLAEAARHVRDAQERRESRDSGRGSSRKESKDRSDKSASSSSCKNDASSTSSVPHKYSPPSVMSESVVVSSSTMNSTNSSTNSLIAGNSQTSIGSTSGPWRSKLNNIKNSFLGTPRFHRRKMSNGTAESDSEDSQMIDTTDLVKKSWFGSLASSMSVERDDTHCVPVQGKTLNSIKAELIRAFLQIHELSHSVVGQNCFRVEYKRGPTVGGSVFSRGIKMNVDIIPSPQQVVIAGETPTYVVQFVLLAGPVRRFKRLVEHLSAILQNSTQQRADRQQQAALMVRPRRLSDSSVGSACSDSESNASSINMIARHSDKTETTSATSSDPYGPSPSMRSVGSGTANSYKSPTPHRRNTTAVTASSSSASNRYGPSSSSSGSYSNNADYSYHPEYSQRSNGSSAPKNQYSPGSQRSFAFSMFNKADKV

SEQ ID NO: 26697 - protein, 356 aa, Caenorhabditis elegans
MGCNFSSQSKLQVPEIRASRSITPASQKSEDPYSHIRLLLLGSAESGKTTVLEQVRLLYKQHFTESEYFHRRAFIYHNIFKSIKALCRAMRMSDIQFADPINMGRAQSIIADEHGHYGLFSKDLAEKIKHIWNDKSMQKLYARRSQFNLNDSASYFLNNIDKINMVDYKPSERDLIMAYVPTCGVQNVIFTACNQSFQLFDIGGQKIDRRKWALQYEGIDAIFFCIAISEYDQVMSEDMVTNRLDDALNLLQSISEDPAFATTPIYLFLNEIDVFCEKLSVIPLSKYKPDFKGGDQDDAIDFMENLACEALGKRDRSLYRVYRCIAIDTQMMAELLSTCFLKKERRLIRYANNIPV

SEQ ID NO: 26698 - protein, 452 aa, Caenorhabditis elegans
MFSLRKFRMNQRELLITDHMERLKKEINKRRTRMENEAEQQCGLLTPWRKARARPHRAAKPKAEVKKEVINPADITLGGDTYDYVKEQKPTESIATNVSRRRRTSANLSKSEDDRDKPESQSTAPKSKERRTSEPPASHVAFHTPGSATPHDINLSIEHCTCQKIFDASKLYIQCELCARWYHGDCVGVAEQTILGLEHWSCEECIEEQERVKDQPALYCVCQKPYDDTKFYVGCDSCQGWFHPECVGTTRAEAEQAADYNCPACTREAEGYESEASDVSGSSRVSVQLTRADYTHVFELLELLLEHRMSTPFRNPVDLNEFPDYEKFIKKPMDLSTITKKVERTEYLYLSQFVNDVNQMFENAKTYNPKGNAVFKCAETMQEVFDKKLIDVREQMTARQQMLLLATAQQQDPMSSIRKRVQSESQRTVDSLDIDSDQLLPLDANLMRLYDF

SEQ ID NO: 26699 - protein, 1922 aa, Caenorhabditis elegans
MPHDSKMTSVVSRLLHALGKSHDHEEPETPPNPDSLLVYVCKLATSRSDSTSSTQSATAGFILNEEPITLFRLELERLQYILHFPEEVAFQLSSTEYQLFYSIQPMDYVRYVSCDLTSVPVSENPSPVRNLVKRLSEVSSWITHVIVSQPTHDDRKVALTAILRIVETCWNIGNFNAAVEVLMGLKSEKLRPFWLSLRQEEKSQFDSLCETLLPANQALPSQAYINAVQRALRMPQSRVIPFFGIFLRDLYAIVNDLPNIVVIGQEGETQKLEFMSDPNGEDHFSSRIGVGGLLNADKINLVAIVLDNLELFHRHSRTMIKLLEEQAVPPIQIPQNEREQKEKEAKTYEPVQVVRGSSHGVALIPLDTLTFDLDVIQRLQHGTTVIHYEPDSGRSNLCLLRLDPSCGQINWHKISYSVNKDPKEKDVLAKVSVSNLQPLDSGRGAPSPMPSGRTPGTGGVGVEEGELKLSVVKGVELVDSYDIDIEAIYRRHSMEEMSVPVSCWKVSHGQLLSDNEFIYFLAPQQIAQFWTNGLQSVVKSLQGQQRYPDRRMLWIKNVYLSLYEITGESNCGPRPFEALQAFGGRVERWKGFGLSQTNTNATRPNDSSLSSEPGGAKSRLKNLKNAMQKKLRGASREGSRSQSPQPHSPLVRPPSIKSQISSQSGPPGPNSPGYLLKPRGEPANSDAGDIDSIYTPRSRTPTSSSYGGRSVGGRSCKSWRSRGGETPNSGSISSSGQMSIQVSGLSGPSGKEFQEKPLTLVEFAELFRLFNTRMRKDLRDVFNDVLSTATTPQHCPKRERDRHSPRMQSRLASVSNSYNADFLSNDFLTRNTAVTSHHISEKQNKIYNALALASVNSMGGLMDTSRSSMLTPQMLRAFVNTHQMEQIDEQTAIKLIQDHEPDGICRQKNQMSFEGFTRFLCDPVNFAFVPETIEPDEEDLRYPLSHYYINSSHNTYLTGHQLKGPSSSEMYRQVLLTGCRCVELDCWDGDDGLPLIYHGHTLVSKIGFRQVVEIIKKSAFITSDLPVILSIENHCSLQQQAKMAQMFKTVLGDLLVSNFLFEADFSDSPRLPCPLQMKNKILIKNKKMIVDPPTPLPMIERGAVQRGETQLNLHRKQSKNSYESRSVFTRHIKLIGFSLLTYNLNYSNSNSIFRSSTVDEVEDDDLDEFLDDEENEEDDQEEVQVRSEKEDSPKTSKRAEKSARNIKQQDSLCSDHSVEQAKPSTSKTTSKTNDRKTEDEVLYAQLAQNAIRNQQPRKNNTGVQIAPELSDIVIYMQATKFKGFPPVDGIQSPRIMEEGPASASLSFSSRARTPSNLLNTPAPPRRQRSSTQLSQELAAEFLGSVRANATATCYQVTSLNENAAKKLMKRHPAKCVSYTRDHLIRTYPSAKHYDSSNFNPINCWAHGMQMVALNFQTPDVIMAVNQAMFEQSGNCGYQLKPRCLWDESHLLYNKFLPLSKDIAGHSALLLNLTIISGQHVYPNTHYASLYVEIEVIGIHNDCVREKSKVVQRNSVNPIWNHTTQLRIACVDLAFLRIAVCDSGQNGRVVAHRVVPVKCIRPGFRHLPLRTPTNLPIDNAMIFLRTRFEQEEHIYLHDDDSNTYCNLEHTLAYRTDLTPNLSPTPILKKQIFVLRITGAFADETAITVHSESGSTVKTVMQQALLNAGKNADQVEEYVLIEESLPAPSGEDPIEQRVLPLNEPIMDAVACWNGSMRRFVLRKKGSDPSSRAWITSIIKSGTSGSSTSVSPSPLTKDGHVKSASSNQLHGRSLDTDAFGEHLEVTEGKCKDTNRSGHDKTKCVIFVGLNPRARSMGDTFLVCVHNVSEDQPYAILRAGIHSTAADIIRQVFVKARRSNVDDSEFVLVEETCDDPKLNQGQSMLQALSLARKRSNDRRPLRCFALYIHHFMCFVSQICVFLFTRL

SEQ ID NO: 26700 - protein, 448 aa, Caenorhabditis elegans
MGMSATMGDSASIPGVFFADFGPAPPEITPEGYHEVELNKTKWVLPQWYNSLKPLGEGAYGVVCTAEYEPTGDRVAIKKFFRPFQSTIHAKRTYRELKLLRTLQHDNVLEMIDVFTPDPDASSLNNVYFVSVLMGSDLQNIMKIQRLTDEQIQLLIYQVLRGLKYMSHQNFNSTIILKKLMHPFQRRNTRFRLYIHSAGIIHRDLKPSNIAVNERCEVKVFLSFSQLSFLILSFFKILDFGLARAQDAEMTGYVATRWYRAPEIMLNWMHYTQTVDVWSVGCILAELVSGRPLFPGDDHIDQLTKIMSVVGTPKEEFWSKIQSEEARNYIKNRSPIIRQDFVTLFPMASPYALELLEMMLILDPDRRISVSSALRHDYLREYSVPNDEPVAMDTVINSIVTIDPAEERATTLSDWRELIWNEIRLFQNSARRLSFVSCTDTEEEPMKI

SEQ ID NO: 26701 - protein, 501 aa, Caenorhabditis elegans
MASVPSSSSLPVSHVRRHEDVSTPSAPPTKRSNNQSQPPESYEPNTWLQQQREQEQQKKLAAENIKKQSIEATGNNEMVGEEEEDILSKPCGPHKRRFQFVMIRNITFAIPEGYDVEPNSIEYLGGGSFGNVIKTSAVCRDGLRRYVAIKKMREPFFDPHHARRIFRETKLLQLMRHDNIICALDIYTPDEENDFRDVYVVTEFAGRSLYQILKQQRDYGRRVLTDEHIKFIIYQIIRALKYIHSANIIHRDLKPGNLALTDDSDLMILDFGLARSLEKKDTSLTQYVQTRWYRSPEVIYWKIDSYTNLADMWSLGCIAAELLTGEPLFPGDEPNAQYQRITQLCGSPDEELLTKIENDNSSAIKAVIQSYTTHKRRNFRDVFSAHNPSEDFIDLLEKLLVLDPEKRITVEEAIQHPYLAEFSLPEDEPRADHIFDLDDSQARTRFEWRGKAQRSRNRILHTCKFEKQQMQKYFITDAVWKEIMNYKRLSSSPLIPGEADR

SEQ ID NO: 26702 - protein, 364 aa, Caenorhabditis elegans
MAMCWRVVHTKCKPKFTKHCDFGGLKRTIIPPYCVTTRRPGNRNQRMAVIDKIEIPVDIEKWRPIMVIVNPKSGSGAGKQLLRNFRAHLQPGTSSLDQIDTLSRRIPVAVLPLGTGNDLSRLLKWGKKCDGDIDVIKLMEDIQEAEVTLVDRWTIDAESQKKLGVRLQSNKTLSMTNYVSVGVDACVTLGMQNTRESIPRAMSSRLLNKFLFFTFGTKDVFERVCKGLNERIDLYLDDVHVNLPDIEGLIFLNIPYWGAGVKPWATYNDSHRQECDDEMIEVFAVTSSFHIAQMQIGLASPLCIGQAKHAKLVFKGNHSFPMQSDGEAWVNSAGTVLISHKCKTAMLRKAEKQTTGFFYFLPPF

SEQ ID NO: 26703 - protein, 407 aa, Caenorhabditis elegans
MDPFNQIPSELYGSASSTSIAASTRQPSSQSQPSQQFRQMPADLGASTSTMHSVAPIDIYDNYGNASTSDLRRSSVRGDPRRKEIYAYNAPFTLFSHGWSAATDPSRKFRLAVSSFIEEYSNKIHIVQLDEEAATKIMWIPDQKGTFPDLLATSGDYLRLWRIGTDNNACIESLLNTNRTAEYCAPLTSFDWNELDMNLIGTSSIDTTCTVWQLETGQAIGTTRPTAAIDGTVRTQLIAHDKEVFDISFSRGSAQIFASVGADGSLRLFDLRRLEHSTIMYEDPQRQPLLRLAWNRNDHNYIATFGQDSKEVLILDLRLPCTPVARLRNHEATINGLSWAPHSGSHICTAGDDYQALIWDVHEMPKPINDPILAYRAQAEVNQIHWSSSFPDWISICSDNKLEILRV

SEQ ID NO: 26704 - protein, 145 aa, Caenorhabditis elegans
MGPHRLLYQALCKAGDKFVYPVLPAFAKPAWNHAAGPKTVFFWAPTIKWTLIGAGLADLARPADKLSLYQNSALFATGAIWTRYCLVITPINYYLSSVNFFVMCTGLAQLCRIAHYRIEETPEFHQNEHATEIDAQNLNLFPLFT

SEQ ID NO: 26705 - protein, 1250 aa, Caenorhabditis elegans
MSDYSAKPSGSLARIGDYDLSSDDSDQNDEDETLIASKTIQTGAVQVNDIAVAEASPAETDAKSSASPVSGPEPPTSAVVENRDLDEFKKESGSNDDKQEEINEDKDSNEETVFQQTESGSADVVDKTDVKQKDSDSSADDDHSHSKSGSVHSPQKPQGSTTPCSVQSPASPVGDEQAVKMEEVEEPIVASEEVPDKKPESVKESTDSESSGSEHGFEKMDTAEKVEDECNDDEVAASNGTEEPEPGDKAADTVNPWETPRQEPVDGVVQPRTEPPAGKPTRHTNCLDFVLFTVVKDALKHKHSWPFQLPVDAIKLEIPEYHNIVNTPMDLRTIEKRLRNLYYWCAEDAIKDINQVFINCYSFNPPEYDVYKMAKTLEKQVLSQLTQLPRSDLNTLFDNCKKFNDRNDDIYIMCENIEGVVQRGLEWMPSEEKPADLADHHRRGMFSASTPSGKTKGPKQRGRKSTRGRKKTSLPRGASTFKDESVDDNNDDESSKVDSINFDDDDDTATEKDAESRAESVQPEVVNEEPKPSTSQPPSKKRKAENGEPAVAVKIATPATPVAAHPQEETPRRKNPNTLIEWKHLVPRWQGKIPEWQKFCSKLLNEIHSVKNKGFAQVFYLPVDPIKLKIYDYLEVITNPMDLQTIKKKLDFKQYAEPEEFVHDINLMVDNCCKYNPKGSPAHSNALELRSFFEQRWKLFPRPGVDPIIADSYINQNLVVNTDLIEDERINSYLSAVKAEEKKCAEKLEQLRSMSEGLYTIAMQRREAKLAGNTAPALAQNQLSQLEGLGISIKSTPMMIPELISPALSVRSSSRAPVPKIIDDIGPSPIKARKISKPRASMASNVSVPYTPTGNPRGRKPKKSGRPKKNIYSPATVSERISQQPPFEVTPYVSIYGRKVVGTNDKIELSERMASIPQMYITPILRIIQIGHHNTGKTITSLRSLCEEEIDFNDVSDDLVIELLDYLEMIQKDKAKAEQVRQELEVKAKFYGFEAYDNKLGTIPKTRNMPPPLQHRMRSDSPSPSASRTGNQSSDSDSASDDSSDDEPSRSNSNVAGPRRALELSGNSSSASTPAGPSKAQPAVVRPSSKSVASKPAYTKRTLSESSSSSDSNGSSSDSSDSDSEPKPQAKKPEPPQKKVAKKPAPQQKKKAPLSILDELLPDTPEKKPVMASVPTTSGSARQLPPDSYQKPSQISEAELKAQKEQEHNAALQRREEVARRLRALEDQQQVLNQHEVMHEFESQYGDFSY

SEQ ID NO: 26706 - protein, 629 aa, Caenorhabditis elegans
MKLLWTISTILLISSTVAGSNNGNTRLDMAAQRRASNIHRMDTIILLTYVSVMVLIVVTAWAFKHYRFRFIHESGVTLFYGLLIGFVIRYFGLGLLQSQTFDVITKNKTIVKEPPDYLMLEVKPEGGSRVSFHYELIEGFFADKRKKIEQQIEQKSVFSPEVFFNMLIPPIIFNAGYSLKKRHFFRNIGSILAIVFIGTTISCFGTGCLMFVFTSIFQMGYSFKELLFFGALISATDPVTIISVFNDMNVEADLFALIFGESALNDAVAIVLSEVIENFSTSSEAITLQDFGSAIAGFAGVFFGSLMLGFMIGCMNAFLTKMTLISEHALLESSLFVLISYISFLVAEVCGLTGIVSVLFCGIAQAHYTYNNLSDESQSNTKHFFHMVSFIMESFIFCYIGVSVFVTNNQRWSFSFLLFSLISITASRALFVYPLSWLLNIRRRPKIPKRYQHMILFAGLRGAMAFALAGRNTSTENRQMIFATTTAVVIVTVLVNGGLTSWMIDYLQIKHGKDAIEEGQRLENSMSSSPADQHSDLDESVPVTMSPGLNPWDKAFLPRKWYHFDARWQLLKLVFQFHETSTDPCDAIFGTNTPTVLSSIDFLVDFKPSTRVRQCRALQYNCTIRDSID

SEQ ID NO: 26707 - protein, 634 aa, Caenorhabditis elegans
MSLIRRLSVVLIGLLLILGYAQAECDEKEEEVFPSRYPIAYFKWEEVKIPMTICLWLIAASISKIVFNSIPHLNDLFPDSALLIMIGLIIGIIFKLIGVDKNQFFLESEIFMLYLLPPLVFDAGYFMPARQFFDNFGSIMCFAMIGTLFNFLAISFSLWAISLTGLFSVETPLLHMLLFGSVAADVDPVAVIVIFEELAVNDVLFIAVFGESLFNDGVSVVLYRMFLTFSEIGAENLIPEDFANGGVSFLVVVFGGVGIGVLFAFLASLLTKYSRAEEISILNCVFILILPYTCYLCGELFGLSSIIAVVFCGALMRQYCRENVEQETVKATEKFIKVLSIASETVIFVFLGLSTVSSNHHWDTCFIVLTVVFCLIYRTLGVVVMCHFLNKYRLNKYTKVDQFIMAYGGLRGAIAYGLVVAIPDFIPAKNMFVTSCIIVIYFTVFLQGITLKPIAEFLQVEKKNVHSKNMIEHIYTELIDTTMAGMEDIAGFKGHHWIRDSWNYFNNCYLRPVLVNKNNMKQMDKTKLVRKYKHLVDEDAKKIANGGDLKSNLAFTRALIEHTRSRTNTAITSDSNGKIDFVTHMKEHHGITVYDHENNVEYTSDYMENESEDGEYKNGGFESDGSSDNFEERV

SEQ ID NO: 26708 - protein, 930 aa, Caenorhabditis elegans
MTALRKNSSAEDAFLPSSSASGSGLKKHRKKKKSIAEAQSNPVFVISADPSGPSPSTSPKPAQKRKKRSWRGESAARKLSEALPAALRSPTQILKRTKKPLGPSLSWDPEHRSRSPSMTRSRVHSDGSSETGGIVDGKPQEEDGGIVEEPRFELELTCVHCAMAADYRRRMLKTEIESAVMRLARRLGNGRSGWRDDSPSSSNVSNQSSTGTGITTLHRHTISSHHRGTTPDIVVSSISSDEEDHSVDRYTSSELGNSLQTSEARKALAKSPVVRRTAADQETSNPVNKHRSSRYWIEDEWRHEGRCNTCAKSFQQKMFFQGKEKKETIAVTCSWCKESYHLKNCFARDKLEERCNRGALKEMIVPPTWILRLANRKRSSRTPSHPRKHKKSHRQFVVKPTDLWSSGPSQPLLVFVNPKSGGNKGSKALHTLCWLLNPRQVFDITSLKGPKFGLEMFRKVVTQLRILVCGGDGTVGWVLSTLDNLNWPAYPPMAIMPLGTGNDLARCMGWGGVFSDEPISQLMQAILHETIVTHLDRWRIDVEPNTSCNLEEEDDGMQSALPLTVMTNYFSIGADAHVALQFHHSRSANPQMLNSRLKNRIAYGGLGTIDLFKRSWKDLCEYITLECDGVDVTPRIKELKLHCILFHNITYYAGGTIPWGESSDNKPSCCDGKVEVLGFTTATLAALQMGGKGERIAQCSRVRVITNKAIPMQVDGEPCLLAPSIITLGFHSKVPMLKREKKTPCTPNLMRRGTRYGQKDSQVQSTSLIIQLPVIVVGRADYDNYKDCFERLKDTAYEIGIVNVESEAELDSARVLIQRLLVEHNSLPYEPDKNWRFLDYVSNAEEGTFRVSRQQEHVQSVSDVCNTDECLLILDHAFPSITDREAVELFQPQQPIPSTSTSAAPRYHNSRRISETLRIVLSSDAQETHL

SEQ ID NO: 26709 - protein, 798 aa, Caenorhabditis elegans
MWIKLLFFFTTLLVSTSGLGDDGITALLDPNSTEFSTVLPSNNSEKFSYMLASVKNMNMTASEFEEFIKVLKHRQSKDHSGEHVGNEHDESHGISVVSWHWDYVKNELVLTLFFIVIGLFKLVYHHTFVTRKILPESCCLIFIGIAIGFFFVGDATHASIKFLEFKSKVFFFYLLPPIILESAYSLKDRAFIENIGTILLYAVVGTILNIVLLAAALLILIWVGIMGKYNLSVMDILTFASLVAAVDPVAVLAVFQEVGVNKMLYFMVFGESLFNDAVTIVCYNLAIEFQTLPDFTWYHGFLGLLSFLCVSIGGLIIGLICGAISSFVTKFTTDVRVVEPVVLFGMAYLAYLGSEMFHFSGIIALIACGLFQTHYACCNISYKSFTSVMYITKVCSTLCESLIFIILGVMLVNEREWFWTDWHPVFSAVSVVLCVVVRFGVTFFLTYFVNQFTGGVRHISFQEQFIMSYGGLRGAVSFSLVFMISANPDVKNTMLGATYAVILFTNIIQVIIYLSKITSLNGIKGSTIKLFVKWLNIRLAKKEDHFRLFIEFNNGMVQHLSQGIEDLCGDKSLSLINRMSELSKKYVRPLLEKNYTANKAKKEGKLVELNRAVAMREALNNSPSQSSFQRQHTIDEMAESGALPHDLLDEEHQGHHHHGQVHPDNEDADQRANELIKDVSSIRQLMHNPFEDCYLDRNLTHEEEKEQARLKMKKTRAFKFSSVRKTIGFFGKKKSVRRHATQQGILHSAIATIGVQSVDRPSTSTRVSVEDEEQGLTMKEMEEEHPLMTITESEETSF

SEQ ID NO: 26710 - protein, 895 aa, Caenorhabditis elegans
MSFSRKTLRSSIIKHGGRAKSPAGTGSGRKTVSFSSKNSDAKISNVSDCWNYMQTGSDFVKLRGTNRQFRRFFSLDADLSYIRWTPTNKKPHKARIAIDEIREIRLGKNTELLRSSDEVFTDLQEECLFSIIYGDNYETLDLIASSGDDANIWVTGLMALTSNKYECKPSSSQFATLRERWIESVFDEFDTKKNGHLDEQTAFKAILHINSRISHHRLTNKLKEVTIGAEESERGKIEKSHFVDLYKEIGTRPEVYFLMVRYANKDYLSCQDLRLFLETEQGMVGVTTDNCETLIEQYEPCSEARENNLMTVDGFTSFLFSPDCGVFDPNHRVVTMDMKQPFSRYFISSSRKSYLVEDQLGPSSSDGFSSALKRNCRFLEFDIWDPNEADGDTEPMVQNGQTATSKITISSALRIIREFAFERSRYPLLLKVSVHCSTDWQKVAAMLIVTHLGTRLYLPKNDPTNWDDEKNCPTPWDFQNRILIVGKKLDNPDTDSGEVSEEDDSLASTTRRKSKRIQLCKELSDLVPVFFNVKTLNDLLSTAPGSTTMSSRKNLASVTESTCLRLMHTYATEFGQATRNYCVRVFPNPSRVDSSNLNPQEFWNNGVQMVCLNYQTPGLMMDLQEGKFSDNGGCGYVLKPQVMKDDMFVPSDRVPTSPQILHLRILSGQQLPRPRGSNAKGDSADPFVVVEVFGLPGDCAEERTRTVRNDSINPSFDESFQFQVSVPELALVRFLVLDDDYIGDDFIGQYTIPFECLQPGYRHIYLLNNEGDPLEHATLFVHVAITNRRGGGKAKKRGMSVKRKNSRISSGMKLVGIKSVDDQFKVAVVPLAESTAIRNRLENAMIDWQEECGLGPAGTIRQGIRLIHSRMITLAVNCESIFNAHYQETFKNIDF

SEQ ID NO: 26711 - protein, 547 aa, Caenorhabditis elegans
MQLQQINSGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKGAILTTMIATRNLSSKRSYRLTLGAEKLVISMKNIEYWQVLLNKIFATYKIKMKQCRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 26712 - protein, 708 aa, Caenorhabditis elegans
MQLQQINSGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKAAISAVKMVTRMSGVLRTSDSTGSVASNGSTTHDASQVAGTSSQPTSPAAEVYPNVLLFNPQKFPRNCVHPFTTHPYYSPKESSKKKLFFTLLFEVCPHTSRSHILLRDNTKNIYHPYHCFTNKMSNYERAAPSSHGSSTTKKIANAIADLVIRRSSPSIRRKTEADVHNSNRNRKVSAPANLQHALVPVIDVVVATGALASSSVDNLSASTSSDLGRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 26713 - protein, 375 aa, Caenorhabditis elegans
MGSTCSTPESKEQKRINSVIDKQIRKDEDDEIGNQKLLLLGTGECGKSTILKQINILHSSGFSKADLKNVAGTVYSNIIQGVATLLKAKDHFYYELSTPELDADAQHILSLADSSKDAMPFIPLTFNAIKRLWHDPVVQKTFERRAEFQMMDTLVYFMNELDRINNADYIPTVDDMLRIRIPTMGVVQQTIEIKGTKFRWSSVNGIFNGRPHNLDLVRIYDVGGQRSERRKWIHLFDNVNATIFISAINEFNQKLNEDGQTNRMKESIKLFETICNSRWFVQAAMILFLNKRDLFEQKLKTTSINVLFSTYQGSNDYAECVAYIQMRFERLNKYSDIKKIYTHVTCATDTNQIQLVIDSVVDMVIGRNLRGTGME

SEQ ID NO: 26714 - protein, 775 aa, Caenorhabditis elegans
MSNSEPSTSTPSGKTKKRGKKCETSMGKSKKSKNLPRFVKIQPIFSSEKIKETVCEQGIEECKRMLKGHFNAIKDDYDIRVKDELDTDIKDWLKDASSSVNEYRRRLQENLGEGRTIAKFSFKNCEKYEENDYKVSDSTVTWIKPDRTEEGDLMKKFRAPCSRIEVGDISPPMIYWVPIEQSVATPDQLRLTHMPYFGDGIDDGNIYEHLIDMFPDGIHGFSDNWSYVNDWILYKLCRAALKDYQGSPDVFYYTLYRLWPNKSSQREFSSAFPVLCENFAEKGFDPSSLEPWKKTKIAEGAQNLRNPTCYACLAYTCAIHGFKAEIPIEFPNGEFYNAMLPLPNNPENDGKMCSGNCWKSVTMKEVSEVLVPDSEEILQKEVKIYFMKSRIAKMPIEDGALIVNIYVFNTYIVRPFCEFVKKYVDEDDEESKIRSCRDAYHLMMSMAENVSARRLKMGQPSNRLSIKDRVNNFRRNQLSQEKAKRKLRHDSLRIQALRDGLDAEKLIREDDMRDSQRNSEKVRMTAVTPITACRHAGPCNATAENCACRENGVCSYMCKCDINCSQRFPGCNCAAGQCYTKACQCYRANWECNPMTCNMCKCDAIDSNIIKCRNFGMTRMIQKRTYCGPSKIAGNGLFLLEPAEKDEFITEYTGERISDDEAERRGAIYDRYQCSYIFNIETGGAIDSYKIGNLARFANHDSKNPTCYARTMVVAGEHRIGFYAKRRLEISEELTFDYSYSGEHQIAFRMVQTKERSEKPSRPKSQKLSKPMTSE

SEQ ID NO: 26715 - protein, 1356 aa, Caenorhabditis elegans
MEISQYTKDKASCTRISIESYYSKRVTQCAERENRLKKLEEDISARGLSDEEKEEKRKIHHSKETDYLRLKRTRLTVNDFESLKVIGRGAFGEVRLVQKHDTGHIYAMKILRKSEMVEKEQTAHVRAERDILSEADCDWVVKMYYSFQDYSNLYLVMEFLPGGDMMTLLIKKDTLTEEATQFYIAEAALAIQFIHSLGFIHRDIKPDNLLLDARGHVKLSDFGLCTGLKKFHRTDHYRNWPSTLPPDFISKPFESKRKAETWKRNRRAYAYSTVGTPDYIAPEVFQPNGYTKSCDWWSLGVIMYEMLIGYPPFCSELPQETYRKVINWQQTLVFPSDVPISIEAKATIKRFCCEAERRLGNHGGLDEIKQCPFVKRIDWNHIRERPPPIRVTVKSIDDTSNFDDFPDEDLTWPTSTLIRPEEQPGRRGEFVDFTYKRFDGLTQKMRYILGWLFGEMLWVILSWGLVAVLCYFALNHLGSTGEAAHTSSTFGSSVSGNGVANGGTHTSSGEWSNEIVSWLYSNFHKVPAPMDAWIKSLNEAAKKVTSPTKCEVLFEGFGDHSDVLQPPKISNVRVEHGPRDHLTVRSNVHLPCVKLRLVSSQRTPERMIVSNYDVSIVDLRGEVECRMACIANQLYLMGCFSGRPEMDIELRNTDPNAQYQVSIPMVEESIRRCLLSAVTNINLSEEMPEERNTFADTFSRTIYNPPTHSPSGTMRNSYNNYDTNLHVDAYGTQSSHRSNSPSGDVPEMFKKLNESHLISPSYNTNSIPNKMRIKVIKASRLGREVSQPFVNVEMDEPAQKYSTTKGINANPFWEETFDFDLTPATEEILFEIYEGNDKLHMNDDEGFLGLAIVNFEEIRRSGETVHSLKLQGRPYRKDAISGEITVQFDFFYDPNLLTSGKLTDTVKVTNPNGSEFRETLTTHRRPIYDPHDNFDGHEPIVPSKTTTVTVKTVSQTLKEKPTIQSVHGSLENAVDPATQKILDRQFKNHNDPKTRELEAKLQSVAQSMSASSTLDRPSKNGNNGQYYRDQTAPPEFHEELDVRQSRDKSKKAPTEKRDRSFFGELKDRLSGRRGRSQKRSKSVDVENNQLLEEAVSLPPSRDPSRTRYAVSSNDKYRETHSVGGRSGESTKSLYQHSTLILELDQDKQAKYFLIPPAMLNEPAASRLMRKGKKLHIYNDHTFVAVKVKGGATCNVCQQRIRSSFSKQAYQCRDCKMVCHKTCHYKTDAFCTQSNVSKLQIAKDVDWAHFLSHYQLEEFISNLKLISDIIATTFVISNIHVFPRISKKAHISHHLPILFSLCNHPRRFHFQDKLLVLNESFVKCTRTTGLESFFAPNYTTYVLEKFGKFHFGRYIDS

SEQ ID NO: 26716 - protein, 943 aa, Caenorhabditis elegans
MPASVTHVIFDFDGLLVDTESAYTEANMELLRKYGHVFTMDLKRRQMGKRHDESIRWLINELKIGDLVTPEEYSRQYDELLIEMFKRSPAMPGAEKLVRHLLHTGVPVALCTGSCSRTFPTKLDNHKDWVNMIKLQVLSGDDPEVKHGKPHPDPFLVTMKRFPQVPESADKVLVFEDSYNGVLSALDAGMQCVMVPERSIFDPDSDPEFKNQMQSDEPSTSSASSSRRRIAFGRPPVLRERPLQSPAPITSTSLTSGLDKEPQTSTDNTTTNGEILNPSSSEPTCTSVLSDQKSLDLPKRRAWSFDEVCAFHDGIKLHGKDFDSVVKFMAKRKMEKTKDHVKTFFFNSAKAYKSLLAMTDDDFANIPRDARELFLLINACEYKRKTVNMKVIVEKLKELVFEGTVVVRAGRKLVTIKTPPCPALCRYFSVKKGDKVPNDLYIHLEPTSNGDHVFMRQRNQNPFLRVKLNANDRITKLLEFLHKKWSLAGDSTPISVTLWPDSSCEIASLCVQSAENSPFISLSMNKLIKNVEESKEKLEAKKIEVTGIKVATDVNIKTKPSHTVTYPRPFTLTDEIIAEGINSKNVRNAIVAELFCVCGRKNPIQLRYQVHNENQPIQASEPWKVMINLLNRGYGDCLAPNIFLNIEKTKFFDVPKSCCSKYHYREPSSSASKKKKCDDTTSDVPGNPVSDIVRQETEDFACQLAFLKKTTRKKTAPAKRKPTNPVLATVTPQLLIRPPPGESSSAPAIQDLMVKQVFAAPKTTIIPRRTSTYSEKKSLLLSNAHKISELTATSDSPSTSTQGPTDFSSVVFSPTKRSADPELQRKRNDAFLSSLRTPDPTPKKDSIMQQYFGGDLSMSPGSTRHASHLETPGGNNTTIDFTDMMYQNITNHGDLTTISNPALHFSVNEVHEKYHDMISSSQDSQDYILSHFQKKKTTPKKKK

SEQ ID NO: 26717 - protein, 562 aa, Caenorhabditis elegans
MSSPGGETSTKQQQELKAQIKIGHYILKETLGVGTFGKVKVGIHETTQYKVAVKILNRQKIKSLDVVGKIRREIQNLSLFRHPHIIRLYQVISTPSDIFMIMEHVSGGELFDYIVKHGRLKTAEARRFFQQIISGVDYCHRHMVVHRDLKPENLLLDEQNNVKIADFGLSNIMTDGDFLRTSCGSPNYAAPEVISGKLYAGPEVDVWSCGVILYALLCGTLPFDDEHVPSLFRKIKSGVFPTPDFLERPIVNLLHHMLCVDPMKRATIKDVIAHEWFQKDLPNYLFPPINESEASIVDIEAVREVTERYHVAEEEVTSALLGDDPHHHLSIAYNLIVDNKRIADETAKLSIEEFYQVTPNKGPGPVHRHPERIAASVSSKITPTLDNTEASGANRNKRAKWHLGIRSQSRPEDIMFEVFRAMKQLDMEWKVLNPYHVIVRRKPDAPAADPPKMSLQLYQVDQRSYLLDFKSLADEESGSASASSSRHASMSMPQKPAGIRGTRTSSMPQAMSMEASIEKMEVHDFSDMSCDVTPPPSPGGAKLSQTMQFFEICAALIGTLAR

SEQ ID NO: 26718 - protein, 412 aa, Caenorhabditis elegans
MHCGSGSQVHCLVVIPLKKHNKMEVDLPVHNEYDASRFHQVTIRDPIAGADSTFTIPTRYVNLSFLNAGAQGTVVMADDLVTTQRVAIKKMQQPFVMTMSAKRAYREFILLTTIKHPNIIRLLNAFTPDTSLSTFREVYLVMELMTHNLHEVIHRLRLDHKTLSFFVYQSLCAIKHLHNSGVIHRDLKPSNIVVNDRCVLKVLDFGLARKKNVDTSMRMSDYVVTRYYRAPEVILGLPYSEKVDIWSVGCIFAEMINHTVLFPGKDRIDQWTKIYSVLGTPDDHFISQLGQSAAMYVRSLPRHQARAFSEIVPDTNFLPETENPRVHLTPHVARDLLFNMLKINPEERYSVEDALNHPYVKLWFKDDEVNAPASENRYDQEIDFADKTLIEWKELIFNEVQRYQADHDIFTG

SEQ ID NO: 26719 - protein, 329 aa, Caenorhabditis elegans
MGCFHSTGSEAKKRSKLIDEQLRHDHERCVGEIKLLLLGAGESGKSTIVRQMRILHETGFNKQEQMAYRPVVFSNMVQSMLAILKAMQPLNISFTDAAREEDARMFISHFLHVNNAELSEAFSLELSDLMKQLWMDEGVKKCVKRAHEYQLNDSAEYYFNALDRISSSSYLPTQDDILRARVKSTGIVETTFMYKDLCFKMFDVGGQRSERKKWIHCFDSVTAVIFCVALSEYDLRLAEDQTMNRMHESMQLFDSIVNNCWFTETSIILFLNKMDIFEERIRYTPLTVCFPEYQGGMTITETSTFIQSRFEILNKRQTPAQKASCKALI

SEQ ID NO: 26720 - protein, 320 aa, Caenorhabditis elegans
MGRLIDKQVDRHFITPFRGTFDLNDSKLSRQLTIAMIYDFSMCNGLTDTGVALKKMSDVDEKYSITEPDTLQQIVSDLREGDIESSLDYLEAAQPEEDGNIRTYLHTQLITDNIELGSNNYDKAVKDLRRFKSPFVDDRQKFKHLVGALLVGKPSMIDIRYKYLFDFTNREILTLKMASFFIPYEAPLKNLMRFGMHAMIQLGDLFPVGFAPAAIDDNELPIEIGFHATHSSFTCPILKEQCDAENPPMRLICGHVISKDAINRLTTSIRQQRNSSRLSKFKCPYCPREQLLENTRQVDFLKWCESDYTDEEVQLFQFFN

SEQ ID NO: 26721 - protein, 272 aa, Caenorhabditis elegans
MSSGAEQHNTNGKKCYMNKRYDDAVDHYSKAIKVNPLPKYYQNRAMCYFQLNNLKMTEEDCKRALELSPNEVKPLYFLGNVFLQSKKYSEAISCLSKALYHNAVITNAPDIENALKRARHQKYEEEESKRIVQDVEFHTYLESLIEKDRQENSENPEELQRADMAKKRLTELTLATQEKRQNREVPEMLCGKITLELMKEPVIVPSGITYDREEIVQHLRRIGHFDPVTRKPLTENEIIPNYALKEVGNLYRVIEKFLDDNPWAKYEPGGMV

SEQ ID NO: 26722 - protein, 499 aa, Caenorhabditis elegans
MVRPEDFNSLELDNSLTDGETVHEMMAHKAGLTYNDFNILPGFINFGVHDVSLETNITKDLKIKAPLVSSPMDTVTESGMAIVMALYGGIGIIHGNFPKPEDQAAEVLKVKRFKQGYVMQPHCLSRDSTAFDMIQIKKKYGYTGAPVTEDGRVGSKLIGMVTSRDFDFITMDVAGQKGTPISDIMVSVDQLHLGHINDAPELSQKKLKEHRLGKLPIVNDNGELCALLCRSDLLKARDYPMASYDSKGQLLCGAAVNTRGESQYTVDRVVEAGVDVLIIDSSNGSSTYQISMLRYIKEKHPHVQVIAGNVVTRAQAKLLIDQGADGLRIGMGSGSICITQDVMAVGRAQGTAVYDVARYANQRGIPIVADGGIRDVGYITKAISLGASAVMMGGLLAATTEAPGEYFWGPGGSFNFSESDQIKVAQGVSATMKDRGSCHKFIPYLIRGVQHGMQDIGVRSLRDFREKVDNGIVKFERRSTNAQLEGGVHSLHSFEKRLY

SEQ ID NO: 26723 - protein, 423 aa, Caenorhabditis elegans
MPAKKEGFNRVLDGLKKRQLQHDFKLERAAETYEPTQNIGSGAFGIVCEAVETSSNQKVAIKKVAHASATPTLARRTLREIRVLRYINHPNIVPLRDIFRTKGPLGIDVFLVMDLMQNNLHHIIYGNEDPLEEHYINAFLGQLLRGLEYLHAACIAHRDLKPSNLLVNQDGTLRIADFGMAKCADNSSKKHDDEEHCYYMTQHVATLPYRAPELLFVLPEHSTAVDMWAVGCIFGEMVIRNEILPGRSVQGQIKMLLTMLGQPPQEVINEVRCDRTRKLIQDFGRKADAEWDDIMFCKARGDDQIVRGNCDTIDFVKQLFQYDAQKRINIQDALLHPYIQRVIPAEAPQKKCPFRVKKDMMQVEDLNHQELISMMKQDVRSAENPITYSELHSGGKNFAFTVFLFCFLLTTHVCAFLNTNTSF

SEQ ID NO: 26724 - protein, 647 aa, Caenorhabditis elegans
MVSWGRGKDAYYLYISREQEEDDDDSLSFYSSQKDTEDEFCGCLFPDPEIPGSSSSSGCSSSSTELYDLAAAHAALISRQQQILSQAIPIIPEHQLAAVAAHHQHHQQLHPSVQYQLVAAATHHNHHQPQAAQPHYSAVVPRSDVIQQPPHFALHHHLQNLVQQQQQQQAHHHHQQLVGEMALVSHTHPAAVGSTTCYEKNQQKQQQVQQIPTQPQVAHVSSNAILAAAQPFYPPPVQDSQPDRPIGYGAFGVVWSVTDPRSGKRVALKKMPNVFQNLASCKRVFREIKMLSSFRHDNVLSLLDILQPANPSFFQELYVLTELMQSDLHKIIVSPQALTPDHVKVFVYQILRGLKYLHTANILHRDIKPGNLLVNSNCILKICDFGLARTWDQRDRLNMTHEVVTQYYRAPELLMGARRYTGAVDIWSVGCIFAELLQRKILFQAAGPIEQLQMIIDLLGTPSQEAMKYACEGAKNHVLRAGLRAPDTQRLYKIASPDDKNHEAVDLLQKLLHFDPDKRISVEEALQHRYLEEGRLRFHSCMCSCCYTKPNMPSRLFAQDLDPRHESPFDPKWEKDMSRLSMFELREKMYQFVMDRPALYGVALCINPQSAAYKNFASSSVAQASELPPSPQACRLAVCFFCGLPHV

SEQ ID NO: 26725 - protein, 703 aa, Caenorhabditis elegans
MMLSVEEQVLRNNIELMFTFNSLKILANGVTWQLWESTLNQGTATSGIMRFALKTALSICIFLLIFQTVDSDSSDSSASASVVSGAVKSEDTVVAVNKTDVLGEAIDANATSLEQHGAAIVGNVSEEKKRSLAIFFILFVIMLATLVVHMLIVSKIHWMPESLAIVALGALIGSILSYSRRDWSEIEALSPDVFFLVLLPPIIFENAYNLNKGYFFSNFVPILTFAIFGTTISAMVIGAGLYILGAIGLIFEFTFFECFAFAAMISAVDPVGTLAIFQAVKVESLLYMLVFGESMLNDAVSIVLAATALRHAKPSFNSLPASEIITSAFVTFTEMFFFSACLGVGIGLLSALLFKHVDLRKTPSLEFALLLIFSYIPYGFAEALDLSGIMAILFCGISMSQFTRHNVSPIAQITFRHTFRTISFVAETSTFAYIGMAFFTIKLNFAPWLIFWSVVLCLLGRACNVFPLAYLVNQCRKDVQISMKNQIIMWFSGMRGAVCFALVLYMDLDKEKKSILLTTVLFLILFTTIFLGGSALPFISFINRCYPNERQRKRRRTPRNKESTGNSSALMMSKTQEMSFFGSDDWGPKKSALDATSSAGRIMRQLFVRKFTAIERLENRDKLAALTKRALASDQMTDSDDVEFGGGGGVGGGGRMKDDVTPTRGRSGSRNSSDVIISAGGGGVSGEHHLLISSGSDSSTNEF

SEQ ID NO: 26726 - protein, 250 aa, Caenorhabditis elegans
MTTSLGQTILPYLSFTALSSTVAFFLCGLQICHRIKTRGSSEGTSPAPFLLSFLSCGLFIQYGLLKDDDVITYCNGIGCFLQACYLMYFYYMTRNRRFLNKVISIELGIIGIVVYWVAHSTNSHLTKTTYVGNYCIFLNICSVAAPLFDIGKVVRNKSSESLPLPLCVACFVVCLQWMFYGYIVDDIVILVIGCQTSSQRSSRFCNFHYLSFIRVLRQVFYRRNMSISNHIEYPKPMDQAACRIVGSFSF

SEQ ID NO: 26727 - protein, 437 aa, Caenorhabditis elegans
MAGTTVGLRVKFSGLAMPIADTVTLNSGYEMPVIGYGTWQLPKNLAAERVRDALEAGYRHIDSALSFKNQEEVAAGIKDWCKIRKVRREELFLSSKIWNTYHSRNRCMQQIDEMLEIFETTYMDLIVIHWPFGWAEDEPPGERGLWPRGANGKMRYSDVDYLETWKALEDAHRSGKIRSIGLANFNIGQVEQVWTKGLIKPAVLQVEMNPFLDQEEIRQFCREKGIILTAFMLTGNPGSALYRKHEDPNLLYNETLQSIAKGHGKLELKPKPKPKLKPKTKLKPKPKRKPKPKPKHKHNRPTGTAEKSKKPENPKPKPKPNPKPKPKPKPKPKPKPKPKPKPKHKPKPKPKPKANPEPKANVFFYFKRFFPERIRQNINIFKFRLTSQEIARIKALNIDFRILNPLLGNYDHPYFPWPHVQEEQLPQKVEEPDPENL

SEQ ID NO: 26728 - protein, 331 aa, Caenorhabditis elegans
MLRVTTSIRKTTKNAVGPRTNLEEVLNCIAMAEDIYNYLVHHEKKYVLDDSFINGGNVNSKMRRILVDWLIQVHLRFHLTPETLHLTIFVLDRIIVKNIVSKAEFQLLGVAALFVASKFEDIYLPDILEYEMITDNTFSKKQIMAMEQTILNALNFDLSCPSSLVFLRCISKTLTENDVNPIDKEAFYYVHNISKCLGELALLDSVMSTVPRSHVASASMIITLNVITVDGINPKTAASMIRKQLGASKQDIYDAIALLAQVAYKNFRHQKLCAIRVIYFYKMFTQFCFQEKYQSSKFGRVSYLMTDEILEKIHRMGRNVEASEAETSEME

SEQ ID NO: 26729 - protein, 409 aa, Caenorhabditis elegans
MMKYVTICPEVDHRFPLIFRKFLHQCTMGFNRFLGFVIGSNTEYQNQSTSASFPNDRVSMSSFDENHEATDADGNERDQLLGSQRNIRENLQHFRNSLDNTREGQTVVSITKSIFPFLALFAANFVFDHLYEIFQFIVVYLIFVQADVIVQKMMAGGRLPGIILTDNNLVSGIANKIFQVVYFFGYTIVTVVYLRNYSLDDFEFSNTFGLNISYFMSGEYKELSMSSTLYGVVMTDTFFKLITILPKSLIVIVPDTYVTTSFKRKVLQLLEYCSQLYRCALPFGPWLRHFLFSNPGSGVMIYFFSISYFSLKVGEVYRYSLSVKKSVGNLLTDSSVGTKSVDHEEQPCAVCHGDLLQPIKLECTHVFCKFCIETWLDQKSTCPICRAEVTKDADNDWKNGGTSLALRMF

SEQ ID NO: 26730 - protein, 343 aa, Caenorhabditis elegans
MSSKVPIFTLSNGVLMPSIGLGTWQMTGEEGKTVIRNAVLAGYRHIDTATLYQNEHQIGDALAELFAEGILKREDIFITTKAFCHEVAPDVVEEALRNSLKRLRLDYVDLYLAHIPASTKDDGSFRSDVKVEDIWRGFEKVYGLGLTKAIGVSNFNESQIVRIMNIQKVPIHASQLELHLYLPQKAHRELCKKHNILITAYATLGSPGRMSVVGSNGRPLFESTQNSENEMNDKHVKALAQKYSKTPAQILLRATVEMGIIVIPKTTNPERMKENINIFDFNISNAEVNLLEAHERTKQERLFWWPKYFFLSNKNDTEHYFSALLIILKIHSRHRDNKCPKEI

SEQ ID NO: 26731 - protein, 103 aa, Caenorhabditis elegans
MSGRGKGGKGVGKGGAKRHRKVLRDNIQGITKPAIRRLARRGGVKRISGLIYEETRGVLKVFLENVIRDAVTYCEHAKRKTVTAMDVVYALKRQGRTLYGFGG

SEQ ID NO: 26732 - protein, 495 aa, Caenorhabditis elegans
MCPLSPPPPYPPRHSVSGVNMSTDQQSSVEDQTVAMVNVRRANFKSFWDKYSDKPDTNSMMLNHSAEELESSDRADILASLPLLHNKDVVDIGAGIGRFTTVLAETARWVLSTDFIDSFIKKNQERNAHLGNINYQVGDAVGLKMESNSVDLVFTNWLMMYLSDEETVEFIFNCMRWLRSHGIVHLRESCSEPSTGRSKAKSMHDTANANPTHYRFSSLYINLLRAIRYRDVDNKLWRFNVQWSCSVPTYIKRSNNWRQVHWLAEKVPAEDGAKGTSFNELVELIKNTWQNEQEAWDAKLDDEKYVWTDKVFSSALTSLPSNSTFFLYTPRTVSPYCHINAHTLAETFNANVWNTEIIPEYYRTSLTKSNNLKDQRVRFGWNQSLTDSVTYWQQKDALFDVFVATEFLSTVDDETIRQLPNVMSDGAKFITLEPVDEVNEAEMKQRIQELGYTLKSFTDVTDQCIEAQEQYFKDHEQLRDEKVIRKNWVLLELTH

SEQ ID NO: 26733 - protein, 660 aa, Caenorhabditis elegans
MGHEYDIEELFTWKWDDVHHVYVITVWLLIASLAKICTVLKVEIFLLAFVFNLMKPISKWCPDSSLLIIVGLALGWILHQTSLSGATLDSHTFFLYLLPPIIFDAGYFMPNRALFENFDSVLVFSVFGTIWNTFAIGGSLLLMAQYDLFTMSFTTFEILVFSALISAVDPVAVIAVFEEIHVNEFLFINVFGEALFNDGVTVVLYQMFKSFALIGSENLSVLDYATGGLSFFVVALGGAAVGIIFAIAASLTTKYTYDVRILAPVFIFVLPYMAYLTAEMVSLSSIIAIAICGMLMKQYIKGNVTQAAANSVKYFTKMLAQSSETVIFMFLGLSTISSQHHFDLYFICATLFFCLIYRAIGIVVQCYILNRFRAKKFEMVDQFIMSYGGLRGAIAYGLVVSIPASITAKPMFITATIAVIYFTVFLQGITIRPLVNFLKIKKKEERDPTMVESVYNKYLDYMMSGVEDIAGQKGHYTFIENFERFNAKVIKPVLMRHQKRESFDASSIVRAYEKITLEDAIKLAKVKNNIQNKRLERIKSKGRVAPILPDKISNQKTMTPKDLQLKRFMESGENIDSLYTLFSDLLDRKLHEMNRPSVQITDVDGQDDIQDDYMAEVGSRSNLSAMFRSTEQLPSETPFHSGRRQSTGDLNATRRADFNV

SEQ ID NO: 26734 - protein, 478 aa, Caenorhabditis elegans
MPRARHFFPESAVLIVLGLFAGFTIYELWTVDLFLHPDLFFLYLLPPIVLEAGYFMPNKAFISNITTISLFAVAGTINVFEGCFIFAFQNFYDFNITIVDTLLFSTVISAVDPVAVLSVFEEIHVNKLLYITVFGESLLNDAVTVVLYHSFHSMVRIGQAHLIYQDYTMSMMNFFLVSGGGILVGVVFAVVAALGVKWSSNVSVLQPIICITVPYMAYLCSEIVHVSGILGIVVCGLCMKSYVTGSMEERADITVKYTLKTLSSCCEAIIFVFLGFSIFSKDHKWDFGFAIVTVITCFAARFLVVFTLTWVANKWRMQKISLRDQTIMAFGGLRGAICFGLVLTIDGEVVPAKPIMISTTLIVIVFTVFIQGTMIKPLVSFLNVKIDNAYDKSLFQSCIEHSFEDTMCGVEAIIGAHGQYYWKNKVDKWNAQFLEPALTRQDMNRGRRLLKKLTDMTTDEQREALLQEESAMLEEHQV

SEQ ID NO: 26735 - protein, 1418 aa, Caenorhabditis elegans
MAKEFQFNWKPTIIPELLHGSVFDRYDDESTCLELNAQVRIDENGFFLRWLIEGKDAVVLDMGQIWEARTGGLPKDGRIMFELEQRGASETIAERTIWITHGQDLVNVQSFFLVAESVELAKTCRAGINDILKSSRIRHVCPTTQLIHTWLTMNVNERRKIPIKLIIKTFSSGKPEKMVQKCLNDLGLGGDKYTPARVINRSMGKKFRNFYKCSRGRKRKEREELDVDILTFEKFQRLYNKICPRTEVQELFVKLSGQKEYLTKERLINFLNEEQRDPRLNEILFPFFDSQRIVALLKKHENDIKYQEDGKMSGDGFLRFLMSDENPPVFLDRIEMFMDMDQPLCHYYINSSHNTYLTGRQYGGKSSSEIYRQVLLSGCRCIELDCWDGTGENKGEPIITHGKAMCTDVFFKDVLVQIRDTAFARSDFPVVLSFENHCSKSNQLKMAKYCMDIFGDMLLSKPFEDAPLDPGVSLPSPNRLRKKILIKNKRLKTDIERHQLDQFLREGKLDEEDELNETPEVVGEDSVSPRSGGSGGTGAPEEVDDDTSDDDDDPSVQTSLNVMRTIPTVNTTSNNGSNRSARSSLDTPSPSGGSLMVPDRATSTATSIKNAVLARSPNFSSLRQKLSFKRRQSPLAAGDQRAHPEVEQPVSSSSPATPSISGPPPCATSSGSTSSITITTTGCSTSSSGPSKHILGGEMPAKENDEAHPELKQNFIAKNLKGFGFSKKQPVLTKEEEERIFAEYHYTGATTNIHPLLSSLVNYTHPVKFSGFDVAEANNLHFHMSSFSESTGLGYLKQSAPEFVNYNKRQSSRIYPKGARVDSSNFLPQIFWNAGCQMVSLNFQTPDVYMQLNMGKFEYNGGSGYLLKPDFLRRPDRTFDPFSESPVDGVIAAHCSVRVISGQFLSDRKIGTYVEVEMYGLPTDTIRKEHKTKVIPGNGLNPVYNEDPFVFRKVVLPELAVLRFAVYDENGKQLGQRILPLDGLQAGYRHISLRSDTNQSFILSPVLFVQIVIKTYVPDELSGLVDALADPRAFLSEQKKRQEALAHMGVDDSDIPDVPNTRNMALRHVKQPPRQNGSSADLLANNGQTGSARGDQTSSMASSTIRSPNEQPQPVAVDKFKVDPIEVDDLRRDKAFAKLLKRFQKELDDLRKKHQKQRDSIQKQQQTNVDKLITNNRRSTKKEKGSRRSLTASVSSGCGSASGTVTVSVCSPSGASCSGYSTGGPSTPVACNSDGTGSPATIGSPVPQDLVNNDRVRSLVNTQTGEWSAMVRRHDEEEFELKKVQLKEQFDLLRKLMSEAQKNQMLALKLRLEAEGKDLKQTQTKKSMEDAKVIQLDKGIKTKAERDRRVKELNEKNLKMFVEERKRLAMKAQKHEEQLTKRHLDQLEQLDKDFHKALDAEVGNYKEEQLAAQPTSVV

SEQ ID NO: 26736 - protein, 796 aa, Caenorhabditis elegans
MIRHWPKTTLCIVSNEFCERFSYYGMRTVLTFYLLNVLKFTDSQSTIFFNGFTVLCYTTPLLGSIVADGYIGKFWTIFSVSILYAIGQVVLALASTKNFQSSVHPWMDLSGLLIIAFGTGGIKPCVSAFGGDQFELGQERMLSLFFSMFYFSINAGSMISTFISPIFRSQPCLGQDSCYPMAFGIPAILMIVATLVFMGGSFWYKKNPPKDNVFGEVSRLMFRAVGNKMKSGSTPKEHWLLHYLTTHDCALDAKCLELQAEKRNKNLCQKKKFIDDVRSLLRVLVMFLPVPMFWALYDQQGSVWLIQAIQMDCRLSDTLLLLPDQMQTLNAVLILLFIPLFQVIIYPVAAKCVRLTPLRKMVTGGLLASLAFLITGFVQLQVNTTLPTLPEEGEASISFWNQFETDCTITVMSGIHKRVLPHDKYLHEDKKNKSGIYNLFTTKSPAKGNGDWTLTYDLSYDGACGDTSKLEKTVKVTAKSKKIIYVGVGSFGYYQNTANTDKPTDGTGEFSMGIVTVFNSSYGGNFAMCRQNTSDFDVNHPCNPRHPADFYFWETDYNSHTDDRDQNATITGSLSSQPAVTYKQKSVKPGYWQLYYLLNTPKDVDRQTYNKTATLVAPTNYGFHRVKQGGVFIYALTGTYENPKIHELQIVQSNSVSILWQIPQIVVITAAEILFSITGYEFAYSQSAPSMKALVQALWLLTTAAGDSIIVVITILNLFENMAVEFFVYAAAMFVVIAIFALLSIFYYTYNYYTTDEEDGEIGVDDEEEIEDHNPRYSIDNKGFHPDEKDTFDMHF

SEQ ID NO: 26737 - protein, 339 aa, Caenorhabditis elegans
MSASPPSAVSTISGTAVLGKTMARVQSNPPGSSEFFLIFRTVTLKCKIFQYRTTQRRPRKESKASHHIFQSAGGGATDDSSAEILSVFECPVCLEYMLPPYMQCSSGHLVCSNCRPKLQCCPTCRGPTPSVRNLGLEKIANTVRFPCKFSTSGCPLNFHHADKTEHEELCEFRPYCCPCPGASCKWQGGLSDVMEHLKKIHKSITTLQGEDIVFLATDINLPGAVDWVMMQSCFDYNFMLVLEKQEKYDPAQPTQMFYAVVQLIGSKKEADNFVYRLELSASRRRMSWEATPRSIHEGVVVAIQQSDCLAFDSNAAQLFAENGNLGINVTISRIDTPQR

SEQ ID NO: 26738 - protein, 136 aa, Drosophila melanogaster
MEVDEDGYEVPSSSSKGDKKRFEVKKVSGQQKSRVIVNECTDGNTSSFPLRRKQWNAVALWAWDIVVDNCAICRNHIMDLCIECQANQASATSEECTVAWGVCNHAFHFHCISRWLKTRQVCPLDNREWDFQKYGH

SEQ ID NO: 26739 - protein, 1398 aa, Drosophila melanogaster
MSTCEAAAAGENGSQAKSEESQPPEDQKKKQPQHERNEKQLDKPPENLPQNGKTEAKGAEGACSHPPLDALRSSVLLDAGAASPSIDAIVACKDALLAQKLFASGGGSTPGPSPTSSAVGAGGISGKDLLKLKEPMRVGFYDIERTIGKGNFAVVKLARHRITKNEVAIKIIDKSQLDQTNLQKVYREVEIMKRLKHPHIIKLYQVMETKNMIYIVSEYASQGEIFDYIAKYGRMSESAARFKFWQIISAVEYCHKKGIVHRDLKAENLLLDLNMNIKIADFGFSNHFKPGELLATWCGSPPYAAPEVFEGKQYTGPEIDIWSLGVVLYVLVCGALPFDGSTLQSLRDRVLSGRFRIPFFMSSECEHLIRRMLVLEPTRRYTIDQIKRHRWMCPELLEHVLIAKYNLGAERQTSVEPSEDILRIMAEYVGIGSDKTRASLKKNTYDHVAAIYLLLQDRVSHKKEQSNGLGASALASSTSASRMIYSSRNDHQPTQQQSQQQSKTISTSSILAKDQCHKRLSRHQTVLMSERNAHAGATPTVPDPGPGYYAKYGPLQLPLPLTGHSHLTGYLNGGGVEVDASGIPLPMRYTPLPTAASPAPSNCSSTSSRVGRHSLSSSSPRSHRPVAISLSIDNNPSLANLRCREMMEAGGGPVGAVGVPLASKQLHQTISEFIIKQSTEDCRALLQQSTAVAEGKDDPPKAESSVGGVPPPASTTPTSSTAGPESGSAPCPGEINGKTIKTMSSSSSFDSKANLGQSFRYKMSAEASKLFQTLQESPLPVEQRTKRRVHVGSTNGSGGDSGQETNDAKSNGDSRSEKKVLAQGSSSTDEGCETDQGNDPGSASQESKGSNGGGSGNANGGPTSHSSSDLTRLVGTTASGQSHKMRSYASSSSSSGVLAGSAGSYSKSLSQNLSRGSSKSNCSGPYDSLDFALPSGKGSLPSCMGSSSMLATPTPASASPAGISSEHSSERSLYGSHNSCIHMPGALPLGLGLPQSSASTPTPNPTPPPNGGGVTFLDKRSPIHFREGRRASDGLVAQGLLSSGSLLGTSRVYGSYRYEQAKRHGWLEIQQLQQLQQEAAVGHSHPHAHQHPHQHPHPHPQAYGLEELCQFPNGQFYALPGKHHPLLTLPHHHAHPAQHHHGHHSLFHSGHQATPLLLEAAAGGDMYGHGCYAPPPPPPGLYTHHQLGVGMAVPMSPMQKPPLQQQLLQHRLLQQKRQLFQKQYALEAQLAGRHHHHQQQSHHHHHHFGHSLGPPPPPAPAPEHHLADELYELALLDRPRSGTPRLQHSMTMPGAHAFSQMNLKTSYISQSDQVPGAAPNGAGSGGSTAGVSCSAPPSTAPGTPTVKCKPTTPHGHSLDSDYHTSTPVLSLFTPNWQSLVKPLSESPILEISEHLESV

SEQ ID NO: 26740 - protein, 746 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKILEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFVDYRYSQADALKYVGIEREMEIP

SEQ ID NO: 26741 - protein, 324 aa, Homo sapiens
IRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 26742 - protein, 1231 aa, Cavia porcellus
MSFFNFRKIFKLGSEKKKKQYEHVKRDLNPEEFWETIGELGDGAFGKVYKAQNKETNVLAAAKVIDTKSEEELEDYMVEIDILASCDHPNIVKLLDAFYYENNLWILIEFCAGGAVDAVMLELERPLTESQIQVVCKQTLEALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTIDSNKPIRELIAEAKAEVTEEVEDGKEEDDDEEIENSLPIPTNKRASSDLSIASSEEDKLSQNACILESVSEKTEHNASGDKFSTKVLNEKPCPGEPENAVELVGGAVAVLPDRATELPESGREEKRPKLDRLPDTEDQEMADINSVSEGEEDHAVTSETNIEHNLKPEKERDQEKQPVLENKLVKSEDTTIQTVDLVSQETGEKEVDIHILDSEVVHAVEDTHEKLRKDDTTQKDVISDTSSVGERDEEIGAVPKTAESSAEGAQGDGGKETDEGAQILISKATEGPKASGTEEAPPVTEITETNDTDQKLVENTHEKQLPISSETTLDTSEGLGASEGREVTESGSTEEVEVEGAVSETDEEDVQSETRGAPMAVTQMDTEKNETPHEAPAQVEVQVPVPPQPSEPPPAPIPSININSEAAENKGEMGASLNTETILLPESESQKENDTDSGTGSTADNSSIDLNLSISSFLSKTKDNGSISLQETRRQKKTLKKTRKFIVDGVEVSVTTSKIVTDSDSKTEELRFLRRQELRELRFLQKEEQRAQQQLNGKLQQQREQIFRRFEQEMMSKKRQYDQEIENLEKQQKQTIERLEQEHTNRLRDEAKRIKGEQEKELSKFQNILKNRKKEVLNEVEKAPKDLRKELMKRRKEELAQSQHVQEQDFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFSAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 26743 - protein, 1465 aa, Adiantum capillus-veneris
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLSRGERLGLKHFRPIKPLGSGDTGSVHLVELRGTGQVFALKAMDKSMMLQRNKVHRARAEREILAIMDLPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 26744 - protein, 1102 aa, Suberites domuncula
MATEPAPINILDLETTKETIRLEIRKELKIKEGAEKVLKATVDRKSKSYVTTILKNCSDKLEHLHDELSALQAQVPDVDDVNLGDSPGSPPAHRKSAHIQNLENLERQLTIEQRVKSGAETMIKVYSGAKSRHDRKLLSDAQQMLNDSRTKVEVLRMNIMKMKAVMNAVEVEGAQQKAGAKGPLSQTPEARISLLRYRVDVETRLMQGARSIMKANPNDKKSWQSAQKSIDFSFQKLRLLKLSLEHRLEEFPQLAKAIKGQEQNGDSMPPMMPRPAQLTGTFYLKLLGVEGLLDFTTLRGLPESDLQPCTPPRSNSTSHVVKNTARNFMTLPTPSHREREREREAVEEDGGLGSSGSTNTWYRRGSKHGRSKQSASNLTKQHSLDHIADDCGFEVSASVCLDNKEVDQTKWGAANSSAWEKDIKFDLHQNREIEVCVRSREGDLTVLSGILYLRLEDYFDTNGATYCLPLEPQGILLVEVTYEFPKTERRQPKLKRGKRIFRRGKVLRHTELNTDIVTWARLLNRSAPSTHTDPHISSPMVISTQDKSSKQESPPHSPHTSGGSTPKSPITPTSPPYFDHSGRKRSLQENGGDLPPPIPMSEEDLIVGAPHSATEPIIPPPREFLGGSVSSTDEHRVDDNIGPPPKFIMESWSAVSPTHRHTSPQHQKPRDTGREYNTVISPPPTRPSVPAPTRSPAHQVFPPPPNPSFPTPLSPSRVAPLPPISQPPPAHTKVNRRSIEQSQMQPMYGNTNNVFPEAPPATVVPHLKGLDDYAYMAVLGRGHFGKVLMAEDKKTKELVAIKVLKKGDIVARDEVDSLMSEKRIFETVNSIRHPFLVNLHSCFQTEQHVCFVMEYACGGDLMMHIHQDIFKEPRACFYAACVVLGLQYLHEKGIVYRDLKLDNLLLDKDGYVKIADFGLCKEGMWHGTRTSTFCGTPEFLAPEVLTDVSYTRAVDWWGLGVLIYEMLVGESPFPGEDEEEVFDSIVNDDVRYPRFLSSEAISIMRKLLRRNPEKRLGASERDAMDIRKQPFFRHIDWDKLYHKDIQPPFKPVLRSRLDISNFDEEFTREDPILTPPKNRRSLRSKDQKQFRGFDYSADWTAI

SEQ ID NO: 26745 - protein, 1109 aa, Ipomoea nil
MKVAVNTFLLSLCSTSSIYAAFALNSDGAALLSLTRHWTPIPSDITQSWNASDSTPCSWLGVECDRRQFVDTLNLSSYGISGEFGPEISHLKHLKKVVLSGNGFFGSIPSQLGNCSLLEHIDLSSNSFTGNIPDTLGALQNLRNLSLFFNSLIGPFPESLLSIPHLETVYFTGNGLNGSIPSNIGNMSELTTLWLDDNQFSGPVPSSLGNITTLQELYLNDNNLVGTLPVTLNNLENLVYLDVRNNSLVGAIPLDFVSCKQIDTISLSNNQFTGGLPPGLGNCTSLREFGAFSCALSGPIPSCFGQLTKLDTLYLAGNHFSGRIPPELGKCKSMIDLQLQQNQLEGEIPGELGMLSQLQYLHLYTNNLSGEVPLSIWKIQSLQSLQLYQNNLSGELPVDMTELKQLVSLALYENHFTGVIPQDLGANSSLEVLDLTRNMFTGHIPPNLCSQKKLKRLLLGYNYLEGSVPSDLGGCSTLERLILEENNLRGGLPDFVEKQNLLFFDLSGNNFTGPIPPSLGNLKNVTAIYLSSNQLSGSIPPELGSLVKLEHLNLSHNILKGILPSELSNCHKLSELDASHNLLNGSIPSTLGSLTELTKLSLGENSFSGGIPTSLFQSNKLLNLQLGGNLLAGDIPPVGALQALRSLNLSSNKLNGQLPIDLGKLKMLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 26746 - protein, 112 aa, Synechococcus sp. PCC 7002
MKKVEAIIRPFKLDEVKIALVNAGIVGMTVSEVRGFGRQKGQTERYRGSEYTVEFLQKLKIEIVIDDDQVDAVVDKIVAAARTGEIGDGKIFISPVDQIVRIRTGEKDLEAV

SEQ ID NO: 26747 - protein, 806 aa, Homo sapiens
MSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSITMKDEDLINKCGDDARIYIVFQYHLIIFVLIICIPSLGIILPINYTGSVLDWSSHFARTTIVNVSTESKLLWLHSLLSFFYFITNFMFMAHHCLGFAPRNSQKVTRTLMITYVPKDIEDPELIIKHFHEAYPGSVVTRVHFCYDVRNLIDLDDQRRHAMRGRLFYTAKAKKTGKVMIRIHPCARLCFCKCWTCFKEVDAEQYYSELEEQLTDEFNAELNRVPLKRLDLIFVTFQDSRMAKRVRKDYKYVQCGVQPQQSSVTTIVKSYYWRVTMAPHPKDIIWKHLSVRRFFWWARFIAINTFLFFLFFFLTTPAIIMNTIDMYNVTRPIEKLQNPIVTQFFPSVMLWGFTVILPLIVYFSAFLEAHWTRSSQNLVMVHKCYIFLVFMVVILPSMGLTSLDVFLRWLFDIYYLEQASIRFQCVFLPDNGAFFVNYVITAALLGTGMELLRLGSLFCYSTRLFFSRSEPERVNIRKNQAIDFQFGREYAWMMNVFSVVMAYSITCPIIVPFGLLYLCMKHLTDRYNMYYSFAPTKLNEQIHMAAVSQAIFAPLLGLFWMLFFSILRLGSLHAITIFSLSTLLIAMVIAFVGIFLGKLRMVADYEPEEEEIQTVFDMEPSSTSSTPTSLLYVATVLQEPELNLTPASSPARHTYGTMNNQPEEGEEESGLRGFARELDSAQFQEGLELEGQNQYH

SEQ ID NO: 26748 - protein, 282 aa, Mesembryanthemum crystallinum
MSLIANFESDFAVLESIRRHLLEDWDPRAGAPAITTGSGPVYHRNSSFSSLYPCLTDNWGELPLKEDDSEDMVLFGVLRDAVHTGWSPQSGSESGSGSPAPVTVKPEPVDSPVSSPAPVRVAGGEAPVAAAPARGKHYRGVRRRPWGKFAAEIRDPAKNGARVWLGTFETAEDAALAYDRAAFRMRGSKALLNFPLRVNSGEPDPVRITSKRSSPERSVSSSSSESASPKRRKKEEVVVGPVAGQARPGLQQVGNVVEGMQVGVGCQVGVGTMPLGDQLLVT

SEQ ID NO: 26749 - protein, 161 aa, Lycopersicon esculentum
MVPTPQSDLPLNENDSQEMVLYEVLNEANALNIPYLPQRNQLLPRNNILRPLQCIGKKYRGVRRRPWGKYAAEIRDSARHGARVWLGTFETAEEAALAYDRAAFRMRGAKALLNFPSEIVNASVSVDKLSLCSNSYTTNNNSDSSLNEVSSGTNDVFESRC

SEQ ID NO: 26750 - protein, 248 aa, Lycopersicon esculentum
MTENSVPVIKFTQHIVTTNKHVFSEHNEKSNSELQRVVRIILTDADATDSSDDEGRNTVRRVKRHVTEINLMPSTKSIGDRKRRSVSPDSDVTRRKKFRGVRQRPWGRWAAEIRDPTRGKRVWLGTYDTPEEAAVVYDKAAVKLKGPDAVTNFPVSTTAEVTVTVTETETESVADGGDKSENDVALSPTSVLCDNDFAPFDNLGFCEVDAFGFDVDSLFRLPDFAMTEKYYGDEFGEFDFDDFALEAR

SEQ ID NO: 26751 - protein, 413 aa, Malus x domestica
MGYGSNDSRENAQQTDIGAAVRNGREILLQAFNWESHKHDWWRNLETKVPDIGRSGFTSAWLPPATHSFAPEGYLPQDIYSLNSKYGSENLLTSLLHKMKQHKVRAMADIVINHPVGTTRGHGGKYNRYDGISLSWDERAATSCTGGLGNPSTGDNFHGVPNIDHSQLFVRKDITGWLQWLRNNVGFQDFRFDFARGYSAKYVKEYIEGAKPIFSVGEYWDSCNYNGHGLDYTQDSHRQPIVNWINGTGQLSTAFDFTTKGILQEAVKGQLWRLRDPQGKPPGVVGWWPSRSVTFLDNHDTGSTQAHWPFPTNHIMEGYTYILTHPGIPTVFYDHFYDWGDSIHDQIVKLIDIRKRQDIHSRSSITILEAQPNLYSAMIGEKVCMKIGDGSWCPAGREWTLATCGHRYAVWNK

SEQ ID NO: 26752 - protein, 336 aa, Pseudomonas putida
MSYQIALNFEDGVTRFIEATGHETVADAAYRQGINIPLDCRDGACGTCKCKAESGRYDLGDNFIEDALNEDEIAEGYVLTCQMRAESDCVIRIPASSQLCKTEQASFEAAISDVRQLSASTIALSIKGEALSRLAFLPGQYVNLKVPGSEQSRAYSFSSLQKGGEVSFLIRNVPGGLMSSFLTNLAKAGDSMSLAGPLGSFYLRPIQRPLLLLAGGTGLAPFTAMLEKIAEQGSEHPLHLIYGVTNDFDLVELDRLQALAARIPNFTYSACVANPDSQYPQKGYVTQHIEPRHLNDGDVDLYLCGPPPMVEAVSQYVREQGITPANFYYEKFAAAA

SEQ ID NO: 26753 - protein, 253 aa, Pseudomonas putida
MNNRFQGKVALVTGAAQGIGRGVCWRLKAEGAQVVAVDRSELVHELAGEGMLTLTADLEQHTDCARVMASAVETFGRLDILVNNVGGTIWAKPFEHYEVEQIEAEVRRSLFPTLWCCHAALPYMLERGSGAIVNVSSIATRGVNRVPYGAAKGGVNALTACLAFETAGRGIRVNATAPGGTEAPPRRVPRNSAEQSEQEKRWYQQIVDQTLDSSLMHRYGSIDEQVGAILFLASDEASYITGVTLPVGGGDLG

SEQ ID NO: 26754 - protein, 298 aa, Xenopus laevis
MTDAAISFAKDFLAGGVAAAISKTAVAPIERVKLLLQVQHASKQITADKHYKGIMDCVVRIPKEQGFVSFWRGNLANVIRYFPTQALNFAFKDKYKKIFLDNVDKKTQFWRYFAGNLASGGAAGATSLCFVYPLDFARTRLAADVGKGANEREFKGLGDCLVKISKSDGIKGLYQGFNVSVQGIIIYRAAYFGIYDTAKGMLPDPKNTHIFVSWMIAQTVTAVAGFASYPFDTVRRRMMMQSGRKGADIMYSGTIDCWKKIARDEGSKAFFKGAWSNVLRGMGGAFVLVLYDELKKVI

SEQ ID NO: 26755 - protein, 253 aa, Petunia x hybrida
MGRGRVELKRIENKINRQVTFSKRRNGLLKKAYELSVLCDAEVALIIFSSRGKLYEFGNAGITKTLERYQRCCLNPQDNCGERETQSWYQEVSKLKGKFEALQRTQRHLLGEDLGPLSVKELQNLEKQLEGALAQARQRKTQIMMEQMEELRRKERHLGDVNKQLKVKVSLELSSLEAEGQAGLNRALPFLWTSNALEAGNSNFPVHHSQSNPMDCGPDPVLQYRDHHYMAADGPSGSRSMAVETNIMQGWGL

SEQ ID NO: 26756 - protein, 366 aa, Chlamydomonas sp. W80
MMATAGSSAAGARVSMRAASGIRASSSSRRAAVVVKAANVNIGDSLAEFLAVATPDTKLRQLMTSMSEATRTIAHKVRTASCGGTACVNSFGDEQLAVDMVADGILFEALKYSHVCSYACSEEVPEPVAMGGSGYSVAFDPLDGSSIVDTNFSVGTIFGVWPGDKLTGITGRDQAAAGMGVYGPRTVFVIAINGFPGTHEFLLQDDGKWLLVKSTEEIGEGKLFAPGNLRAIFDNPEYSKLVSYYLEEQYTLRYTGGMVPDVFQILVKEKGVFTNVTSPSTKAKLRLLFEVAPLALLIENAGGASSCDGLVCRALDVEVTAHEQRTQICYGSKGEVARFEKYMLGESSASLTLSRPSKRPCAERAR

SEQ ID NO: 26757 - protein, 491 aa, Streptococcus pyogenes
  unsure (1)..(491): unsure at all Xaa locations
SNWDTKFLKKGYTFDDVLLIPAESHVLPNEVDLKTKLADNLTLNIPIITAAXDTVTGSKXAIAIARAGGLGVIHKNXSITEQAEEVRKVKRSENGVIIDPFFLTPEHKVSEAEELXQRYRISGVPIVETLANRKLVGIITNRDXRFISDYNAPISEHXTSEHLVTAAVGTDLETAERILHEHRIEKLPLVDNSGRLSGLITIKDIEKVIEFPHAAKDEFGRLLVAAAVGVTSDTFERAEALFEAGADAIVIDTAHGHSAGVLRKIAEIRAHFPNRTLIAGNIATAEGARALYDAGVDVVKVGIGPGSICTTRVVAGVGVPQVTAIYDAAAVAREYGKTIIADGGIKYSGDIVKALAAGGNAVXLGSXFAGTDEAPGETEIYQGRKYKTYRGXGSIAAXKKGSSDRYFQGSVNEANKLVPEGIEGRVAYKGAASDIVFQXLGGIRSGXGYVGAGDIQELHENAQFVEXSGAGLIESHPHDVQITNEAPNYSV

SEQ ID NO: 26758 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSAARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTANGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 26759 - protein, 741 aa, Vitis vinifera
MESCDCIDPPWPGDELLMKYQYISDFFIALAYFSIPLELIYFVKKSAVFPYRWVLVQFGAFIVLCGATHLINLWTFGMHSRNVEVVMTTAKVLTAVVSCVTALMLVHIIPDLLSVKTRELFLKNKAAELDREMGLIRTQEETGRHVRMLTHEIRSTLDRHTILKTTLIELGRTLSLEECALWMPTRTGLELQLSYTLRQQNPVGFTIPIQHPVINQVFSSNRAVKISPNCPVARLRPLAGKYMPGEVVAVRVPLLHLSNFQINDWPELSTKRYALMVLMLPSDSARQWHVHELELVEVVADQVAVALSHAAILEESMRARDLLMEQNVALDLARREAETAVRARNDFLAVMNHEMRTPMHAIIALSSLLQETELTPEQRLMVEAILKSSSLLATLINDVLDLSRLEDGSLQLENGTFNLHALFREVLYLIKPIASVKKLFVSSSLAPDLPEFAVGDEKRLMQIMLNVVGNAVKFSNEGNISIFAFIAKSESLRDSRAPDFFPVHSDNHFYLRVQVKDSGAGIDPQDISKLFTKFAQCQSLAARNSGGSGLGLAICKRFVNLMGGHIWIESEGLGKGSTAVFIVKLGIPEYSNESKLPFFPKVSANHCQTNFPGLKVLVMDDNGVSRSVTKGLLVHLGCDVTTVSSADDCLRVVSQEHNVVFLDVCMPGVDGYEVAIRIHEKFTTCRQGPLLVALMGNTDRVTKENYLRVGINGVVLKPVSVDKMRCVLSEVLEHRFLFETC

SEQ ID NO: 26760 - protein, 357 aa, Bacillus subtilis
MRKLGKQLAEKGHEIHFITSSIPFRLNTYHPNIHFHEVEVNQYAVFKYPPYDLTLASKIAEVAERENLDIIHAHYALPHAVCAYLAKQMLKRNIGIVTTLHGTDITVLGYDPSLKDLIRFAIESSDRVTAVSSALAAETYDLIKPEKKIETIYNFIDERVYLKKNTAAIKEKHGILPDEKVVIHVSNFRKVKRVQDVIRVFRNIAGKTKAKLLLVGDGPEKSTACELIRKYGLEDQVLMLGNQDRVEDLYSISDLKLLLSEKESFGLVLLEAMACGVPCIGTNIGGIPEVIKNNVSGFLVDVGDVTAATARAMSILEDEQLSNRFTKAAIEMLENEFSSKKIVSQYEQIYADLAEPE

SEQ ID NO: 26761 - protein, 504 aa, Sphingomonas sp. LB126
MMESTGNAAIFEQARARIARPFGHFINGLWEAGSGEPIAVVNPATEQPIGSIAAGGEAEVDRAVAAARQRFESAEWTRMPAAERERLLLRLADLVERDRDELAAIETLDNGMPFAPARMMAVGSAISAIRYNAGWARRMTGEEAPVSVPGRWHGYTSREPLGVAALIVPWNAPFAITCNKVSAALAAGCTVVLKPAELAPMSGLRLAELVQEAGFPDGCLNVVTGLGAQAGAALVRHPGVDKISFTGSTATGQSILRETAGRLTRVSLELGGKSAVLVFPDADLEKAIPAVAMGIFGNSGQVCAAGSRLFLHDSVFDRFVTGLVDFAEKLMVGPGDQPGVALGPLISAGQKERVMGYIAAGEAEGAQIATRGSAPDEPGYFVKPTIFVDTRPDMRIVREEIFGPVLSVMRFSDDNLENLARQANDSIYGLSAYVWTRDLSTAHAMARYLRAGSVKVNGSGMEFALPFGGFKQSGIGRENGPRGGGSLYRKEVGNDRLVMVWTAL

SEQ ID NO: 26762 - protein, 117 aa, Hordeum vulgare subsp. vulgare
KHMIEDDCADNGIPLPNVNSKILSKVIEYCNKHVQAKPADAAGPGASDALPPADDLKNWDAEFVKVDQATLFDLILAANFLNIKGLLDLTCQTVADMIKGKTPEEIRKTFNIKNDFS

SEQ ID NO: 26763 - protein, 124 aa, Vicia faba
  unsure (1)..(124): unsure at all Xaa locations
MASTKKITLKSSDGEAFEVDEAVALESQAIKHMIEDDCADSGIPLPNVTSKILAKVIEFCKKHVXAAASDDKPTEDELKAWDADFVKVDQVTLFDLILAANYLNIKNLLDLTCQTVADMIKGKT

SEQ ID NO: 26764 - protein, 113 aa, Vicia faba
KHMIEDDCADETGIPLPNVTSRILAKVIEYCKKHVEAPKIDEYGMPVDGKDMKKWDAEFVKVDQDTLFDLILAANYLDIKSLLDLTCKTVANMMDGRTPDEIRRTFNIKNDFT

SEQ ID NO: 26765 - protein, 405 aa, Populus nigra
MGFLCCSGKPSKRLESSSINENNSNIKRKDQTHVTSGSLKMKPYVNNLSKEGESKDDQLSLDVKSLNMKDEISKDRRSNGKQAQTFTFEELAAATSNFRSDCFLGEGGFGKVYKGYLDKINQAVAIKQLDRNGVQGIREFVVEVVTLSLADHPNLVKLIGFCAEGDQRLLVYEYMPLGSLENHLHDIPPNRQPLDWNTRMKIAAGAAKGLEYLHNEMKPPVIYRDLKCSNILLGEGYHPKLSDFGLAKVGPSGDKTHVSTRVMGTYGYCAPDYAMTGQLTFKSDIYSFGVVLLELITGRKAIDQRKERGEQNLVAWARPMFKDRRNFSCMVDPLLQGQYPIRGLYQALAIAAMCVQEQPNMRPAVSDLVMALNYLASHKYDPQVHSVQDSRRSPSRPGLDKDRGQ

SEQ ID NO: 26766 - protein, 406 aa, Populus nigra
MGFLCFSGKSSKRSENSSIDENNSNIKRKDQTQLTSGSMKVKPYVNDSREEGASKDDQLSLDVKSLNLKDEISKDIRNNGNPAQTFTFEELVAATDNFRSDCFLGEGGFGKVYKGYLEKINQVVAIKQLDQNGLQGIREFVVEVLTLSLADNPNLVKLIGFCAEGDQRLLVYEYMPLGSLENHLHDIPPNRQPLDWNARMKIAAGAAKGLEYLHNEMAPPVIYRDLKCSNILLGEGYHPKLSDFGLAKVGPSGDHTHVSTRVMGTYGYCAPDYAMTGQLTFKSDVYSFGVVLLELITGRKAIDQTKERSEQNLVAWARPMFKDRRNFSGMVDPFLQGQYPIKGLYQALAIAAMCVQEQPNMRPAVSDVVLALNYLASHKYDPQIHPFKDPRRRPSHPGLDKDNGRT

SEQ ID NO: 26767 - protein, 782 aa, Oryza sativa (japonica cultivar-group); identical to SEQ ID NO: 940

SEQ ID NO: 26768 - protein, 813 aa, Oryza sativa (japonica cultivar-group); identical to SEQ ID NO: 941

SEQ ID NO: 26769 - protein, 749 aa, Oryza sativa (japonica cultivar-group); identical to SEQ ID NO: 942

SEQ ID NO: 26770 - protein, 319 aa, Populus euramericana
MEFPVISMEKLNGEERAATMEKIKDACENWGFFELLNHGISHEFLDTVERMTKEHYKKCMEQRFKELVASKALDGVQTEIKDLDWESTFQLRHLPKSNIAEIPDLDDEYRKVMKEFALKLEKLAEELLDLLCENLGLEKGYLKRAFYGSNGSPTFGTKVSNYPPCPKPDLVKGLRAHTDAGGIILLFQDDKVSGLQLLKDGQWIDVPPMRHSIVVNLGDQLEVITNGKYKSVEHRVIAQTDGTRMSVASFYNPGSEAVIYPAPALVEKEAEEKKKVYPKFVFDDYMKLYAGLKFQAKEPRFEAMKAVETTVNLGPIATA

SEQ ID NO: 26771 - protein, 263 aa, Glycine max; identical to SEQ ID NO: 3020

SEQ ID NO: 26772 - protein, 488 aa, Escherichia coli
MKKVNHWINGKNVAGNDYFQTTNPATGEVLADVASGGEAEINQAVAAAKEAFPKWANLPMKERARLMRRLGDLIDQNVPEIAAMETADTGLPIHQTKNVLIPRASHNFEFFAEVCQQMNGKTYPVVDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVGALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 26773 - protein, 411 aa, Candida albicans
  unsure (1)..(411): unsure at all Xaa locations
MDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAXVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 26774 - protein, 464 aa, Lycopersicon pennellii
MARVTLFLLLLLVYGVVSEHFIVETLPGFHGKLPFTLETGYISVGEEEKVQLFYFFVQSERDPRNDPLMIWLTGGPGCSGLSSFVYEIGPLTFDYANSSGNFPKLELNSYSWTKVANIIFIDQPAGTGYSYANTSEAYNCNDTLSVTLTYDFLRKWLMDHPEYLNNPLYVGGDSYSGIFVALLTRKIYDGIEVGDRPRVNIKGYIQGNALTDRSIDFNGRVKYANHMGLISDKIYQSAKANCNGNYIDVDPNNILCLNDLQKVTRCLKNIRRAQILEPYCDLPYLMGILQETPTNGQSVFPIAGPWCREKNYIYSYVWANDKAVQKALNVREGTTLEWVRCNESMHYRGKERTESYVYDVPSVIDDHQHLTSKSCRALIYSGDHDMVVPHLSTEEWIETLKLPIADDWEPWFVDDQVAGYKVKYLQNDYEMTYATVKGAGHTAPEYKPEQCLPMVDRWFSGDPL

SEQ ID NO: 26775 - protein, 305 aa, Pichia jadinii
MATEKKQSTFLIDFLMGGVSAAISKTAAAPIERVKLLIQNQDEMIKQGRLAKRYDGIADCFRRTAGEEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 26776 - protein, 305 aa, Pichia jadinii
MATEKKQSTFLIDFLMGGVSAAISKTAAAPIERVKLLIQNQDEMIKQGRLAKRYDGIADCFRRTAGDEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 26777 - protein, 483 aa, Emericella nidulans
QHEEKIRRENETKIKQEMIKRQQQEQERERRRIAEQRQAEEQAKEENRRQHLAAQQAQAQLAAQQQQNRHVMAQANGVSQGPQSSPVVRNQTPLNTSSPLVGNAMATQASVPMAMTASMQGAGSPQRPPSALQHAHPNMMSHPMGPSRSQQGQSRHGTPQMTQGTPAMSQATPIMRNVTPTQRMSHASPPRSSMAPTPVMNQAVMATPQMGSQSFNHQQQQFLMQRQQLLAQQGQHLNHSQLTPQQFAQLQANMLAQNNIQNQQQQQMMQQQQQQQQQQQQQQQQNHQNQQQKFANPQTYQAQMMRAQLMQMQLAQQQQQQRQQQSQQQQQAQPQGQQQPQHQQGQMLQNSPQLNAQQQQMLMAAAQANGGQLPQNMQGMGMQPRMSTPARYNQLYQQRLLRLRQDMATRLMPQYGPPTQYPPQVAQEYSVGLENAAKGFVQDLIRRERVEFAAAQQRQAQAAAHAQAVQQQQHNMMQNGMGK

SEQ ID NO: 26778 - protein, 246 aa, Oryza sativa
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQLQWDQTQPQTISSSSSFMMREALPTTNISNYPAAAGERIEDVPAGQPQHVRIGLPPWMLSHING

SEQ ID NO: 26779 - protein, 148 aa, Nepenthes alata
MGSDLFGSYAESSCAALIVASISSFGVNHDLTAMMYPLLVSSVGILVCLLTTLFATDFFEIKTVKEIEPALKRQLIISTALMTVGIALVTWVSLPSSFTIFNFGTQKVVKNWQLFLCVAVGSWAGLIIGFVTEYYTSNAYSPVQDVAD

SEQ ID NO: 26780 - protein, 85 aa, Cucumis melo
GLMRATDVMIAGKVAVVCGYGDVGKGCAAALKQAGARVIVTEIDQSVLQALMEGLQVLTWKMLSRRLISRHTRNKDIIMVDHIGR

SEQ ID NO: 26781 - protein, 147 aa, Euphorbia esula
MDKAKNFVAEKIAHVQKPEATISKVDLSSVHRDRVEYSAKVSVNNPYGHPLPVCEVSYTLKSDGREIAKGTMADPGSLKASGTTELIVPVGVPHSIIVSLVKDVAKDWDIDYELQVGLTIDLPVIGNFTIPLNTKGEVKLPTLSDCF

SEQ ID NO: 26782 - protein, 264 aa, Solanum tuberosum
MAELREKWCLKGTTALVTGGSKGIGYAIVEELANFGARVYTCSRNENELQECLDIWRKKGLKVEGSVCDLLSRTEREKLMKTIEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPQIETAIKKNPQQKEEIDSIVVKTPLGRAGKPEEVSAVIAFLCFPAASYITGQIIWADGGFTANGAF

SEQ ID NO: 26783 - protein, 486 aa, Nocardioides sp. KP7
MINAKLIINGREETSDRTIDVVSPADTRVVLGSVPDATSEQVDEAVQAAATAFPEWSSRPLEERQGALFAAAGAIHDMIEEYAPLLSRENGKILEESHIDLEFASGICGYTAGISAEALADQRIHDAGGTTLIRRRPIGPVAAVTPWNFPVVLSFMKLAPALVAGNTVVLKPSENSPLVLTEVIRALQEHFPPGVLNMVTGGDATGEALVAHPLIRKIGFTGGIDTGRKVMAVAAQDIKRVTLELGGNDPAVVLDDVDLSPETMRRIAKGAFSATGQVCFGLKSIYVPTRIHDRFVEAFHAAVDEIVVGPGDDPRSTMGPLNNAQQKGSVEKILEEARGAGAVVTTLGRKLDTAAWEHGHFMMPSVVTDADPRLAIVEQEQFGPTVPVVRYTELDEVIRLTNRSQFGLAASIWSADEDRAFELGRRLDTGSVFINSHSFSSLDPRAPFGGTKNSGLGREFSPASLDAYTELQTISRRTGPPGPPLS

SEQ ID NO: 26784 - protein, 356 aa, Arabidopsis thaliana
MKNGLIIINCIILTIGTCGGPLLTRLYFTNGGKRIWFMSFLSTAGFPIILIPLLVSFLSRRRGNRNPNNAENKRKTKLFLMETPLFIASIVIGLLTGLDNYLYSYGLAYLPVSTSSLIIGTQLAFNALFAFLLVKQKFTPFSINAVVLLTVGIGILALHSDGDKPAKESKKEYVVGFLMTVVAALLYAFILPLVELTYKKARQEITFPLVLEIQMVMCLAATFFCVIGMFIVGDFKVIAREAREFKIGGSVFYYALIVITGIIWQGFFLGAIGIVFCASSLASGVLISVLLPVTEVFAVVCFREKFQAEKGVSLLLSLWGFVSYFYGEFKSGKKVVDKPQPPETELPILPVSDYVA

SEQ ID NO: 26785 - protein, 151 aa, Drosophila melanogaster
LESSDGVIFSTEVKAAKLSETIKTMLEVSAVENDENAVVPLPKVNAFILNKILTWAYHHKDDDDQAAEGEELTPQSPHDISPWDANFINVDQPILFEITVAANYLEIKGLEDLCCKTLANMIRGKTPEEIRQTFNIEDDLPIDTAELGENL

SEQ ID NO: 26786 - protein, 474 aa, Catharanthus roseus
  unsure (1)..(474): unsure at all Xaa locations
MALNSLSPPKIKTISFLDSSKSNYNLNLLKLPGGFAFKKKDFGASGGKKIQCSVQPPPPAWPGRAVAEPGYKTWEGQKPISIVGSTGSVGTQTLDIVAENPDKFRVVALAAGSNVTLLADQVKTFKPQLVSVRNESLVNELKEALSDVDDKPEIIPGEQGVVEVVRHSDAVTVVTGIVGCAGLKPTVAAIEAGKDIALANKETLIAGXPFVLPLAHKHKVKILPADSEHSAIFQCIQGLPEGALRRIILTASGGAFRDWPVEKLKEVKVADALKHPNWNMGKKITVDSATLFNKGLEVIEAHYLFGAEYDNIDIVIHPQSIIHSMVETQDSSVLAQLGWPDMRLPILYTLSWPDRISCSEITWPRLDLCKLGSLTFKTPDNVKYPSMDLAYAAGRAGGTMTGVLSAANEKAVELFIDEKISYLDIFKVVELTCAKHQAELVTSPSLDEIIHYDLGARDYAASFQNSLGLSPALV

SEQ ID NO: 26787 - protein, 411 aa, Cicer arietinum
MPLKNIVREFKGMKNGIGSKSKRGGDSKHWLCRSKSHVAPDVTPFEPIQQGQWASLPPELLLDIIRRVEESETSWPARAVVVFCASVCKSWRSVTKEIIKTPQQCGRITFPISLKQPGPRDCPIQCFIRRNRESSTFLLYLGLVPSEHESNKLLLVARKIRRATGTEIVISLAADDFSRASNNYVGKLRSNFWGTKFTIYDSQPPHDIIVQPNCRGGKFNSKQVSPRAPACSYLVSSISYELNTLWTRGPRRMHCVMNSIPVSAIEEGGNAPTPTLLPQIFDEPFSPSPALKGKSPMTDSYSGNLSELPELSQGSVEPLVLKNKAPRWHEQLQCWCLNFVGRVTVASVKNFQLVAAVDPSHNVSSEEQERVILQFGKIGKDIFTMDYSYPLSAFQAFAICLTSFDTKPACE

SEQ ID NO: 26788 - protein, 530 aa, Euphorbia esula
METQLATKNPSSQPPPPPPELAAPPSSNLKKIVVVASIAAGVQFGWALQLSLLTPYVQLLGIPHTWAAFIWLCGPISGMLVQPIVGYHSDRCTSRFGRRRPFIAAGAASVAVAVFLIGYAADLGHMSGDSIGKSPKIRAIAIFVVGFWILDVANNMLQGPCRALLADLSGTSQKKTRLANALFSFFMAVGNILGYAAGAYTHLYKIAPFTLTKACDVYCANLKTCFFISIALLLVLTVIALTYVKEKQWSPEIAKTVAGVDGDDEDGPVEAAPLPFFGEIFAALKNLQRPMRILLLVTCLNWIAWFPFLLFDTDWMGREVYGGSSDSSATAGESKLYDRGVRAGALGLMLNSVVLGFTSLGVELMARKLGKVKRLWGIVNFLLAICLALTILITKLAESGRHYPTVNGVVSTTPSPPSSGIKAGALTLFAVMGIPQAITYSVPFALASIFSNDSGAGQGLSLGVLNLSIVIPQMLVSVASGPFDALFGGGNLPAFVVGAVAAAASGVLALTYLPSPPPDLPAKALTVGFH

SEQ ID NO: 26789 - protein, 389 aa, Euphorbia esula
MEDASATTTAPSDSLNNHQLPPTAGIENIPATLSHGGRFIQYNIFGNIFEVTAKYRPPIMPIGKGAYGIVCSALNSETGEHVAIKKIANAFDNKIDAKRTLREIKLLRHMDHENVVAIRDIMPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEEELGFLNENAKRYIRQMSVFRRQSFTEKFPTVHPAAIDLVEKMLTFDPRQRITVEDALAHPYLTSLHDISDEPVCMTPFSFDFEQHALTEEQMKELIYREALAFNPEYQQQ

SEQ ID NO: 26790 - protein, 213 aa, Euphorbia esula
MAGIKVHGAAMSTATQRVLVCLEEKGLDYELCPVNMATGEHKKQPFLSINPFGQVPGFEHGDLKLFESRAITQYITHENAQKGTNLLCQGKEMAILGVWLEVEAQKFEPVASKLNWEIVFKPMFGMQTDPAAVEENETKLAGVLDVYETRLSQSKYLGGDSFTLADLHHLPNLQLLLNHQSKKVIDARPKVAAWAADITARQTWAKVLALHKK

SEQ ID NO: 26791 - protein, 153 aa, Euphorbia esula
MDTGAKLKKGAGERKGGGPKKKPVSRSVKAGLQFPVGRIGRFLKKGRYAQRVGSGAPVYLAAVLEYLAAEVLELAGNAARDNKKNRIIPRHVLLAVRNDEELGKLLAGVTIAHGGVLPNINPVLLPKKAEKAAAAATKEPKSPAKATKSPKKA

SEQ ID NO: 26792 - protein, 454 aa, Asparagus officinalis
MGPPDVVPSEHVEFDFSDVFGPSPTPTSTGVNVFASDGSTPAASDDIVYTEPAVILARSHSLVGPTALVCQSPRLRKHILHEADLELVECPSGVEGEQDKPFSCVAEEHEVPSSENVERVGLEDFDFLKVVGQGAFGKVFQVMKKGTSEIYAMKVVRKDTILEKNHSEYMKAERDILTKIDHPFIVQLRYSFQTKYRLYLVLDFVNGGHLFYQLYHQGLFREDLARIYTAEIVSAVSHLHANGIMHRDLKPENILLDADGHVMLTDFGLAKEFEENTRSNSLCGTIEYMAPEIIQGKGHDKVADWWSVGILLFEMLTGKPPFIGGNRDKIQQKIVKDKLKLPAYLTSEAHSLLKGLLQKEASKRLGGGPAGSNEIKNHKWFKLINWRKLEAREIQPSFKPNVAGKICVANFEERWTSMPLTVSPVASPVAGSGNFSGFTYVKPSVFLQKPSPLG

SEQ ID NO: 26793 - protein, 249 aa, Geobacillus thermoleovorans
MSIEQKTAIVTGGANGIGKAIARAFAKQGANVVIIDRDIQNGEAFAAQLQSDGFEAIFVAADVRKVDDIERFVQEAAGRFGRIDYLINNAGVSRWKSPYELTVEEWDDVLSTNLRSAFFASREAAKYMRRNAKGGAIVNIASTRALMSEPNSEAYAASKGGLVAMTHALAVSFADDRIRVNCISPGWIETGDYGQLRDIDHRQHPAGRVGKPDDIARACLYLCDEENDFITGVNLVIDGGMTRKMIYIE

SEQ ID NO: 26794 - protein, 637 aa, Nicotiana tabacum
MMESCDCIEALLPNDDLLVKYQYLSDFFIAFAYFSIPLELIYFVHKSACFPYRWVLMQFGAFIVLCGATHFISLWTFFMHSKTVAVVMTIAKILTAAVSCITALMLVHIIPDLLSVKTRELFLKARAEELDKEMGLIIRQEETGRHVRMLTHEIRSTLDRHTILKTTLVELGRTLDLAECALWMPCQGGLNLQLSHNLNNLLPLGSTVPINLPIINEIFSSPGAIQIPHTNALARMRNTAGRYIPPEVVAVRVPLLHLSNFHINDWPELSARSYAVMVLILPMNGLRKWRDHELELVQVVADQVAVALSHAAILEESMRAHDQLMEQNIALDVARQEAEMAIHARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEVYPMPSDGQFYLRVQVRDSGCGISPQDIPFVFTKFAETRNTSNRSSGGEGLGLAICRRFIQLMKGNIWIESEGLGKGTTVTFVVKLGVCNHPNALPLLPMAPRGRLNQGSDDLFRYRQFRGDDGGMAVTVQRYQRSL

SEQ ID NO: 26795 - protein, 1042 aa, Mus musculus
MRPKTFPATTYSGNSRQRLQEIREGLKQPSKASTQGLLVGPNSDTSLDAKVLGSKDASRQQQMRATPKFGPYQKALREIRYSLLPFANESGTSAAAEVNRQMLQELVNAGCDQEMAGRALKQTGSRSIEAALEYISKMGYLDPRNEQIVRVIKQTSPGKGLAPTPVTRRPSFEGTGEALPSYHRLGGANYEGPAALEEMPRQYLDFLFPGAGAGTHGAQAHQHPPKGYSTAVEPSAHFPGTHYGRGHLLSEQPGYGVQRSSSFQNKTPPDAYSSMAKAQGGPPASLTFPAHAGLYTASHHKPAATPPGAHPLHVLGTRGPTFTGESSAQAVLAPSRNSLNADLYELGSTVPWSAAPLARRDSLQKQGLEASRPHVAFRAGPSRTNSFNNPQPEPSLPAPNTVTAVTAAHILHPVKSVRVLRPEPQTAVGPSHPAWVAAPTAPATESLETKEGSAGPHPLDVDYGGSERRCPPPPYPKHLLLPSKSEQYSVDLDSLCTSVQQSLRGGTEQDRSDKSHKGAKGDKAGRDKKQIQTSPVPVRKNSRDEEKRESRIKSYSPYAFKFFMEQHVENVIKTYQQKVSRRLQLEQEVAKAGLCEAEQEQMRKILYQKESNYNRLKRAKMDKSMFVKIKTLGIGAFGEVCLACKLDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGNHMRQDSMEPGDLWDDVSNCRCGDRLKTLEQRAQKQHQRCLAHSLVGTPNYIAPEVLLRKGYTQLCDWWSVGVILFEMLVGQPPFLAPTPTETQLKVINWESTLHIPTQVRLSAEARDLITKLCCAADCRLGRDGADDLKAHPFFNTIDFSRDIRKQPAPYVPTISHPMDTSNFDPVDEESPWHEASGESAKAWDTLASPSSKHPEHAFYEFTFRRFFDDNGYPFRCPKPSEPAESADPGDADLEGAAEGCQPVYV

SEQ ID NO: 26796 - protein, 406 aa, Homo sapiens
MADGNEDLRADDLPGPAFESYESMELACPAERSGHVAVSDGRHMFVWGGYKSNQVRGLYDFYLPREELWIYNMETGRWKKINTEGDVPPSMSGSCAVCVDRVLYLFGGHHSRGNTNKFYMLDSRSTDRVLQWERIDCQGIPPSSKDKLGVWVYKNKLIFFGGYGYLPEDKVLGTFEFDETSFWNSSHPRGWNDHVHILDTETFTWSQPITTGKAPSPRAAHACATVGNRGFVFGGRYRDARMNDLHYLNLDTWEWNELIPQGICPVGRSWHSLTPVSSDHLFLFGGFTTDKQPLSDAWTYCISKNEWIQFNHPYTEKPRLWHTACASDEGEVIVFGGCANNLLVHHRAAHSNEILIFSVQPKSLVRLSLEAVICFKEMLANSWNCLPKHLLHSVNQRFGSNNTSGS

SEQ ID NO: 26797 - protein, 504 aa, Homo sapiens
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSSEQILATLKGHTKKVTSVVFHPSQDLVFSASPDATIRIWSVPNASCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 26798 - protein, 588 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 26799 - protein, 108 aa, Homo sapiens [sequence omitted]

SEQ ID NO: 26800 - protein, 113 aa, Homo sapiens
MADVEDGEETCALASHSGSSGSKSGGDKMFSLKKWNAVAMWSWDVECDTCAICRVQVMDACLRCQAENKQEDCVVVWGECNHSFHNCCMSLWVKQNNRCPLCQQDWVVQRIGK

SEQ ID NO: 26801 - protein, 437 aa, Brassica napus var. napus
  unsure (1)..(437): unsure at all Xaa locations
MKGVRKTYDNSYTLSSLFVFFVLIILRPIFSTTTLSSTESLTISSNRTLVSPGNIFELGFFNTTSSSRWYLGIWYKKISERSYVWVANRDNPLSNAAGTLKISGNNLVLLGHSNRSVWSTNLTRENERSPVVAELLANGNFVMRDTNTTXSSRFLWQSFDYPTDTLLPEMKLGYEPKTGLNRFLTSWRSSDNPSSGDFSYKLEARRLXELYLSSGIFRVHRSGPWNGIRFSGIPDDKKLSYLVYNFTENSEEVAYTFLMTNKSIYSRLTVSFSGYLERQTWNPTLGMWNVSWSLPFDSQCDSYRMCGPYSYCDVNTSPICNCIQGFIPSNVEQWDQRVWANGCIRRTRLSCSGDGFIRMKNMKLPETTMATVDRSIGVKECEKKCLSDCNCTAFANADIRNGWTGCVFWTGRLDDMQNYVTDHGQDLYVRLAAADLV

SEQ ID NO: 26802 - protein, 412 aa, Lycopersicon esculentum
MDPDAFSASLFKWDPRGAMPPPSRLLEPVAPPQPPPSLPPPPPPQPLPTSSYSIRSTRELGGLEELFQAYGIRYYTAAKIAELGFTVNTLLDMKDEELDDMMNSLSQIFRWDLLVGERYGIKAAIRAEWRRLEEEEARRRGHILSDGGTNVLDALSQEGLSEEPVQQQHEREAAGSGGGGTWEVAAGGGGRMKQRRRKKAGRERRGEEDEETEELGEEDEENMNQGGGGGGISERQREHPFIVTEPGEVARGKKNGLDYLFHLYEQCRDFLIQVQTIAKERGEKCPTKVTNQVFRYAKKAGASYINKPKMRHYVHCYALHCLDEDASNALRRAFKERGENVGAWRQACYKPLVAIAARQGWDIDAIFNAHPRLAIWYVPTKLRQLCHSERSNAAAAASSSVSGGVADHLPHF

SEQ ID NO: 26803 - protein, 186 aa, Lycopersicon esculentum
MDPDAFSASLFKWDPRGAMPPPSRLLEPVAPPQPPPSLPPPPPPQPLPTSSYSIRSTRELGGLEELFQAYGIRYYTAAKIAELGFTVNTLLDMKDEELDDMMNSLSQIFRWDLLVGERYGIKAAIRAEWRRLEEEEARRRGHILSDGGTNVLDALSQEGLSEEPVQQQHERVVEVHGKWLPVVVVG

SEQ ID NO: 26804 - protein, 651 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 26805 - protein, 2039 aa, Homo sapiens
MDIVDTFNHLIPTEHLDDALFLGSNLENEVCEDFSASQNVLEDSLKNMLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 26806 - protein, 661 aa, Homo sapiens
MEGAAAPVAGDRPDLGLGAPGSPREAVAGATAALEPRKPHGVKRHHHKHNLKHRYELQETLGKGTYGKVKRATERFSGRVVAIKSIRKDKIKDEQDMVHIRREIEIMSSLNHPHIISIYEVFENKDKIVIIMEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDARGLIRWMLMVNPDRRATIEDIANHWWVNWGYKSSVCDCDALHDSESPLLARIIDWHHRSTGLQADTEAKMKGLAKPTTSEVMLERQRSLKKSKKENDFAQSGQDAVPESPSKLSSKRPKGILKKRSNSEHRSHSTGFIEGVVGPALPSTFKMEQDLCRTGVLLPSSPEAEVPGKLSPKQSATMPKKGILKKTQQRESGYYSSPERSESSELLDSNDVMGSSIPSPSPPDPARVTSHSLSCRRKGILKHSSKYSAGTMDPALVSPEMPTLESLSEPGVPAEGLSRSYSRPSSVISDDSVLSSDSFDLLDLQENRPARQRIRSCVSAENFLQIQDFEGLQNRPRPQYLKRYRNRLADSSFSLLTDMDDVTQVYKQALEICSKLN

SEQ ID NO: 26807 - protein, 807 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFFTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 26808 - protein, 428 aa, Mus musculus
MGPPPGIGVYCRGGCGAARLLAWCFLLALSPHAPGSRGAEAVWTAYLNVSWRVPHTGVNRTVWELSEEGVYGQDSPLEPVSGVLVPPDGPGALNACNPHTNFTVPTVWGSTVQVSWLALIQRGGGCTFADKVHLASERGASGAVIFNFPGTRNEVIPMSHPGAGDIVAIMIGNLKGTKILQSIQRGIQVTMVIEVGKKHGPWVNHYSIFFVSVSFFIITAATVGYFIFYSARRLRNARAQSRKQRQLKADAKKAIGKLQLRTLKQGDKEIGPDGDSCAVCIELYKPNDLVRILTCNHIFHKTCVDPWLLEHRTCPMCKCDILKALGIEVDVEDGSVSLQVPVSNEASNTASPHEEDSRSETASSGYASVQGADEPPLEEHAQSANENLQLVNHEANSVAVDVVPHVDNPTFEEDETPDQEAAVREIKS

SEQ ID NO: 26809 - protein, 415 aa, Mus musculus
MAENLYRARSRVYSPSVLFLHPDMGIGGAERLVLDAALALQEYGCDVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSALKKFYRAPIDWIEEYTTGMADRILVNSQYTASVFKETFKTLSHRNPDVLYPSLNIGSFDLAIPEKIDDLVPKGKQFLFLSINRYERKKNLPLALRSLVQLRNRLPSQEWDKVHLFMAGGYDDRIPENVEHYKELKKMVQESDLERHVTFLRSFSDRQKISLLHGCLCVLYTPSNEHFGIVPLEAMYMQCPVIAVNNGGPLESIVHKVTGFLCEPDPVHFSEAMEKFIHKPSLKATMGLAGKARVAEKFSADAFADQLYQYVTKLV

SEQ ID NO: 26810 - protein, 214 aa, Cowpox virus
IHAIRLINDSTDAQHIHFGFRNMVIIDNECANIQSSAENATDTGHHQDSKINIEVEDDDDDDDDDDDDDDDDDDDDDDDDDDDDVIDDDDYNPKPTPIPEPHPRPPFPRHEYHKRPKVLPVEEPDPVKKDADRIRLDNHILNTLDHNLNSIGHYCCDTAAVDRLEHHIETLGQYAVILARKINMQTLLFPWPLPTVHPHAIDGSIPPHGRSTIL

SEQ ID NO: 26811 - protein, 540 aa, Triglochin maritimum
MELITILPSVLPNIHSTATVLFLLLLTTALSFLFLFKQHLTKLTKSKSKSTTLPPGPRPWPIVGSLVSMYMNRPSFRWILAQMEGRRIGCIRLGGVHVVPVNCPEIAREFLKVHDADFASRPVTVVTRYSSRGFRSIAVVPLGEQWKKMRRVVASEIINAKRLQWQLGLRTEEADNIMRYITYQCNTSGDTNGAIIDVRFALRHYCANVIRRMLFGKRYFGSGGEGGGPGKEEIEHVDATFDVLGLIYAFNAADYVSWLKFLDLHGQEKKVKKAIDVVNKYHDSVIESRRERKVEGREDKDPEDLLDVLLSLKDSNGKPLLDVEEIKAQIADLTYATVDNPSNAVEWALAEMLNNPDILQKATDEVDQVVGRHRLVQESDFPNLPYIRACAREALRLHPVAAFNLPHVSLRDTHVAGFFIPKGSHVLLSRVGLGRNPKVWDNPLRFDPDRHLHGGPTAKVELAEPELRFVSFTTGRRGCMGGPLGTAMTYMLLARFVQGFTWGLRPAVEKVELEEEKCSMFLGKPLRALAKPRQELLQSF

SEQ ID NO: 26812 - protein, 533 aa, Triglochin maritimum
LITILPSVLPNIHSSATLFLLLLMTTALSFLFLFKQHLAKLTKPKSTTLPPGPRPWPIVGSLVSMYMNRPSFRWILAQMEGRRIGCIRLGGVHVVPVNCPEIAREFLKVHDSDFASRPVTVVTRYSSRGFRSIAVVPLGEQWKKMRRVVASEIINAKRLQWQLGLRTEEADNIVRYITYQCNTSGDTSGAIIDVRFALRHYCANVIRRMLFGKRYFGSGGVGGGPGKEEIEHVDATFDVLGLIYAFNAADYVSWLKFLDLHGQEKKVKKAIDVVNKYHDSVIDARTERKVEDKDPEDLLDVLFSLKDSNGKPLLDVEEIKAQIADLTYATVDNPSNAVEWALAEMLNNPAILQKATDELDQVVGRHRLVQESDFPNLPYIRACAREALRLHPVAAFNLPHVSLRDTHVAGFFIPKGSHVLLSRVGLGRNPKVWDNPLQFNPDRHLHGGPTAKVELAEPELRFVSFTTGRRGCMGGLLGTAMTYMLLARFVQGFTWGLHPAVEKVELQEEKCSMFLGEPLRAFAKPRLELLQSF

SEQ ID NO: 26813 - protein, 467 aa, Lycopersicon esculentum
MSTKPTPLELSEMSTMSLDETFHPNKVSESTESSSSSTTPLKPHTGGDIRWDAINSATGRGGPPLNLSNFRLLKRLGYGDIGSVYLVELRGTNAFFAMKVMDKGSLASRNKLLRAQTEREILSLLDHPFLPTLYSHFETDKFYCLVMEFCSGGNLHTLRQKQPNKHFTEEASRFYASEVLLALEYLHMLGIVYRDLKPENVLVRDEGHIMLSDFDLSLRCSVNPTLVKSSSVHGGGGGGNPSSGSGILDNDNAVQGCIQPSTFFPRNILPTKKNRKSKSDFGLFVGGSLPELMAEPTNVRSMSFVGTHEYLAPEIIRGEGHGSAVDWWTFGIFLYELLHGTTPFKGAGNRATLFNVVGQPLRFPETPQVSAIARDLIRGLLVKEPHKRIAYKRGATEIKQHPFFEGVNWALVRSAVPPSIPEPVDFAQYASKDASAPCSDKKMPDTESHDKSKNTCTDSSYIDFEYF

SEQ ID NO: 26814 - protein, 222 aa, Canavalia lineata
MARQKIKIKKIDNVTARQVTFSKRRRGIFKKAEELSVLCDAEVGLIIFSATGKLFEYPSSSMKDIITKYNQHSHDNNQLGRPQNLQVEQCVDLSKEVAERNQQLRQMKGEDFQGLNLDDLQQLEKTLETGLERVNETKEKRIMDEIVALHKKGLKLEEENKHLKQKMAMLCMGKSSFLVDSDITLQEVVSSESMNVCSCNSGPSLEDDSSDTSLKLGLPFPN

SEQ ID NO: 26815 - protein, 255 aa, Petunia integrifolia
MSTSNASTSGVRKGAWTEEEDLLLRECIEKYGEGKWHLVPVRAGLNRCRKSCRLRWLNYLRPHIKGGDFSLDEVDLILRLHKLLGNRWSLIAGRLPGRTANDVKNYWNTHLRKKLIAPHDQKQESKNKAMKITENSIIKPRPRTFSRPAMNHVSCWNGKSCNKNTIDKNEGDTEIIKFGDEKQKPEESIVDGLQWWANLLANNIEIEELVSYNSPTLLHEETAPSVNAESSLTQEGGSGLSDFSVDIDDIWDLLS

SEQ ID NO: 26816 - protein, 255 aa, Petunia integrifolia
MSTSNASTSGVRKGAWTEEEDLLLRECIEKYGEGKWHLVPVRAGLNRCRKSCRLRWLNYLRPHIKRGDFSLDEVDLILRLHKLLGNRWSLVAGRLPGRTANDVKNYWNTHLRKKLIAPHDQKQESKNKAMKITENNIIKPRPQTFSRPAMNHVSCWNGKSCSKNTIDKNEGDTEIIKFSDEKQKPEESIDDGLQWWANLLANNIEIEELVSCNSPTLLHEETAPSVNAESSLTQGGGSGLSDFSVDIDDIWDLVS

SEQ ID NO: 26817 - protein, 129 aa, Petunia axillaris
MSTSNASTSGVRKGAWTEEEDLLLRECIEKYGEGKWHLVPVRAGLNRCRKSCRLRWLNYVRPHIKRGDFSLDEVELILRLHKLLGNKWSLIAGRLPGRTANNVKNYWNTHLRKKLIVPHDQKQESKTKP

SEQ ID NO: 26818 - protein, 120 aa, Petunia axillaris
MSTSNASTSGVRKGAWTEEEDLLLRECIEKYGEGKWHLVPVRAGLNRCRKSCRLRRLNYLRPHIKRGDFSLDEVDLILRLHKLLGNRWSLIAGRLPGRTANDVKNYWNTDLRKKLIAPHD

SEQ ID NO: 26819 - protein, 297 aa, Methanococcus voltae
MSEVKFEHKIASWKVDEVNSLKELLKSGNVIALIDMMEVPSVQLQEIRDTIRDSMTLKMSRNTLMKRAIEEVAEETGNPSFTKLIDCMEKGAALIATEMNPFKLYKTLNESKSPAPIKAGATAPCDIEIKAGSTGMPPGPFLSELKAVGLPAAIEKGKIGIKEDTIVAKEGDVVSAKLAVVLSKLDIKPMEVGLNVLGVYEDGIVYDPEILKIDEDEFLAKLQSAYTGAFNLSVNAVIPTSATIETIVQKAFSNAKAVSIEGAFLTSETSDAILGKATAQMLAVAKLAGEDALDDEL

SEQ ID NO: 26820 - protein, 238 aa, Oryza sativa (indica cultivar-group)
ENTMNRQVTFFKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 26821 - protein, 276 aa, Homo sapiens
MTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 26822 - protein, 98 aa, Secale cereale
PELVKGPWSKEEDDVIIQMVKKYGPTKWSTIAQALPGRIGKQCRERWHNHLNPGINKDAWTQEEEIRLIQAHRIYGNKWAELSKFLPGRTDNAIKNHW

SEQ ID NO: 26823 - protein, 457 aa, Strongylocentrotus purpuratus
MAFSIGNPNASDIMANMAQGGQQFGRKTKRDDITSRNGPQACKRAALGTITNVSSTRVQPSRAAKQFRVSGENSFPVFQDENAHSRIPQGKPFGIPSAGAAPAFSIHVDTTSYVQSSTSTSIKSTDKENEHILLDTALSLPIPQAQRIPLRTFPDVEDNNVSLNEESLTSSEFSPMLLDTSLDAKCISPRTVDIRDLSLGEPEYAEEIYQYLKTAESKHRPKHGYMRKQPDITNSMRCILVDWLVEVSEEYRLHNETLYLAAAFIDRFLSQMSVLRAKLQLVGTASMFVASKYEEIYPPDVKEFVYITDDTYSIKQVLRMEHLILKVLSFDLAAPTINSFLPRFIKAAKANSKTEHLTQYLAELTLQEYDFIKYAPSMIAASAVCLANHTLNNEEWTPTMAHYTDYQLGDIYPCVQDLHQLFIKAPTMEQQAVREKYKSQKYSGASMTPVPTTLPTQ

SEQ ID NO: 26824 - protein, 459 aa, Drosophila melanogaster
MMSSRTQDADGASIRFSDHTLDKATKAKVTLENYYSNLVTQYGERKQRLAKLEAQLKDESLSEAQRQEKRLQHAQKETEYLRLKRLRLGVEDFEALKVIGRGAFGEVRLVQKKDTGHVYAMKVLRKADMLEKEQVAHVRAERDVLVEADHQWVVKMYYSFQDPVNLYLIMEFLPGGDMMTLLMKKDTLSEEGTQFYISETALAIDSIHKLGFIHRDIKPDNLLLDARGHLKLSDFGLCTGLKKSHRTDFYRDLSQAKPSDFIGTCASLSCSPMDSKRRAESWKRNRRALAYSTVGTPDYIAPEVFLQTGYGPACDWWSLGVIMYEMLMGYPPFCSDNPQDTYRKVMNWRETLIFPPRDPISEEAKETIINFCCEADRRWVPASSGGSEVVPFFRGVDWEHILAAPYLEVRSIDDTSNFDEFPDVSLEIPSAPIPQGGEIAKDWVFINYTYKRFEVRNLE

SEQ ID NO: 26825 - protein, 303 aa, Homo sapiens
MASWAKGRSYLAPGLLQGQVAFVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLRTNLTGSFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 26826 - protein, 324 aa, Solanum tuberosum
MVFSSFPVYLDHPNLHQLQQPDGHQQGNTGLENPTLQPPPMQVGASPGSIRPGSMVDRARLAKIPLPEAGLKCPRCDSTNTKFCYFNNYNLSQPRHFCKTCRRYWTRGGALRSVPVGGGCRRNKRSKSNNNNNSSKTAGSNVNTNTIASGTSTSASPSSCSTEIMNGRHHFSHEQPPQLTPLMAAFQNLNHHYGGFQPPPLVSTHHGNGTGALGHHHEMGFQIGSSTNTNNLPVPPGGGSDHQWRLPSLAANTNLYPFQHGTDQGIHESSSVNNNNINAHDDQGLNSTKQFLGTMENNTNQYWGGNAWTGFSGLNSSSSASHLL

SEQ ID NO: 26827 - protein, 726 aa, Xanthomonas campestris
MKSPLPWLKRRLSGRADSEHAQNLIRIIITTLFISYLGWRYQHTHGDTLMATWLILVGELLVSLGLMVAILLRPQVSHTRRLIGMLLDYTCTGAIMAIQGEPASPLYAVCMWVTIGNGLRYGSNYLRAATAMGSLCFLGAILISPYWKANPYLSWGLLLGLIAVPLYFDSLLRAMTRAVREARHANQAKSRFLANMSHEFRTPLNGLSGMTEVLATTRLDAEQKECLNTIQASARSLLSLVEEVLDISAIEAGKIRIDRRDFSLREMIGSVNLILQPQARGRRLEYGTQVADDVPDLLKGDTAHLRQVLLNLVGNAVKFTEHGHVLLRVTRVSGSAEDAVRLRFDVEDTGIGVPMDMRPRLFEAFEQADVGLSRRYEGTGLGTTIAKGLVEAMGGSIGFKENQPSGSVFWFELPMAIGEPLKSSTVRVPTGALVDAPEELESSNIIAFSNPFLRHRARVRSMRMLVADDHEANRMVLQRLLEKAGHKVLCVNGAEQVLDAMAEEDYDAVIVDLHMPGMNGLDMLKQLRVMQASGMRYTPVVVLSADVTPEAIRACEQAGARAFLAKPVLAAKLLDTLADLAVSTRQLATPATTVQVATSFEGVLDSSVLDELAALGMGEEFERQFVRQCLDDAQNCVGDIERDGTCSDWEQLRESAHALRGVASNLGLAQVASSGGELMRMADWQLQAEWRLRLSTLREQLKAGKDALDARVQGVKDGECSPRSNE

SEQ ID NO: 26828 - protein, 262 aa, Streptomyces caeruleus
MTSPADATTEVAVSQESVAMVTGAGRGIGAATAERLAAEGMAVIVVDRTEQDTRATVAAIRTAGGRARGIGCDVAVAQAVTAAVATAVEEFGRIDVLVNCAGINRDRLLLTMGDQEWDTVLDVNLGGTMRCSFAVGRHMRRQGHGRIINFSSVAARGNAGQTNYATAKGAIAGFTRTLAAELGPHGVTVNAIAPGFVATPMVDELAERLGGDRDSVMSEAAKSSAVGRIGTPEEIAATVVFVARPESGYLTGETVHVDGGRP

SEQ ID NO: 26829 - protein, 1056 aa, Spinacia oleracea
MAGNDWINSYLEAILDIGGQGIDASTGKTSTAPPSLLLRERGHFSPSRYFVEEVISGFDETDLHRSWVALHQLAGPQERNTRLENLCWRIWNLARKKKQIEGEEAQRLAKRHVERERGRREATADMSEDLSEGERGDTVADMLFASESTKGRMRRISSVEMMDNWANTFKEKKLYVVLISLHGLIRGENMELGRDSDTGGQVKYVVELARALGSMPGVYRVDLLTRQVSAPGVDWSYGEPTEMLSSRNSENSTEQLGESSGAYIIRIPFGPKDKYVAKELLWPYIPEFVDGALSHIKQMSKVLGEQIGGGLPVWPASVHGHYADAGDSAALLSGALNVPMVFTGHSLGRDKLDQLLKQGRLSREEVDATYKIMRRIEAEELCLDASEIVITSTRQEIEEQWQLYHGFDLVLERKLRARMRRGVSCHGRFMPRMAKIPPGMEFNHIAPEDADMDTDIDGHKESNANPDPVIWSEIMRFFSNGRKPMILALARPDPKKNLTTLVKAFGECRPLRELANLTLIIGNRDDIDEMSTTSSSVLISILKLIDKYDLYGQVAYPKHHKQSDVPDIYRLAAKTKGVFINPAFIEPFGLTLIEAAAYGLPIVRTKNGGPVDIIGVLDNGLLIDPHDQKSIADALLKLVADKQVWTKCRQNGLKNIHLFSWPEHCKNYLSRIASCKPRQPNWQRIDEGSENSDTDSAGDSLRDIQDISLNLKLSLDAERTEGGNSFDDSLDSEEANAKRKIENAVAKLSKSMDKAQVDVGNLKFPAIRRRKCIFVIALDCDVTSDLLQVIKTVISIVGEQRPTGSIGFILSTSMTLSEVDSLLDSGGLRPADFDAFICNSGSELYYPSTDYSESPFVLDQDYYSHIDYRWGGEGLWKTLVKWAASVNEKKGENAPNIVIADETSSTTHCYAFKVNDFTLAPPAKELRKMMRIQALRCHAIYCQNGTWLNVIPVLASRSQALRYLFMRWGVELSNFVVFVGESGDTDYEGLLGGVHKTVILKGIGSNTSNFHATRAYPMEHVMPVDSPNMFQTGGCNIEHISDALSKIGCLKAQKSL

SEQ ID NO: 26830 - protein, 389 aa, Lycopersicon esculentum
MASTKQYFSAAGKPIRCKAAVARKAGEPLVIEEVIVAPPKAHEVRVKIICTSLCHTDITLWKLKEFPGCFPRILGHEAFGVVESVGEDVDELKEGDSVVPIFLPDCMDCVDCKSKKSNLCSKFPIQVSPLLHRNDTSRFSNAAGETLHHFLYISSFSEYTVVDVVNVTKIDPEIPPNRACLLSCGVSTGVGAAWKTANVEPGSTVVIFGLGSIGLAVAEGARLCGATRIIGVDINSNKFEIGKQFGITEFVNSKSCVDKPISQVIIEMTDGGADYCFECVGLATLVQEAFTCCRKGWGKTVVLGVDKPDAHLNLNSFEVLQSQKTLTGALFGGLKPKSDVPILVKRYLDKELQLNKFVTHEVNFEDINKAFDLLIQGKSLRCVIWMDKL

SEQ ID NO: 26831 - protein, 390 aa, Lycopersicon esculentum
MASTVQSGISKTAGKPIRCRAAVARKAGEPLVIEEVIVAPPKAHEVRLKIICTSLCHTDITLWKLKEFPGCFPRILGHEAFGVVESVGEDVDHLKEGDSVVPIFLPDCMDCVDCKSKKSNLCSKFPIQSSLLLHRDDTSRFTNADGETLHHYLYISSFSEYTVVDVVNVTKIDPEIPPNRACLLSCGVSTGVGAAWKTANVEPGSTVVIFGLGSVGLAVAEGARLCGATRIIGVGRNSDKFEIGKQFGVTEFVNSKSCGDKPVSQVIIEMTNGGADYCNECVGLGRVVQEAFACCRKGWGKTIVLGVDKPDARLNLNSFEVLQSNKTLMGSFFGGLKPKSDVHTSLKRYLDKELELDKFVTHEVNLEDINKAFDLLIQLKTLRCVIWMEK

SEQ ID NO: 26832 - protein, 131 aa, Homo sapiens
MAAAVAMETDDAGNRLRFQLELEFVQCLANPNYLNFLAQRGYFKDKAFVNYLKYLLYWKDPEYAKYLKYPQCLHMLELLQYEHFRKELVNAQCAKFIDEQQILHWQHYSRKRMRLQQALAEQQQQNNTSGK

SEQ ID NO: 26833 - protein, 301 aa, Homo sapiens
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGTGFAGSGVKLQAEKSRPVMQA

SEQ ID NO: 26834 - protein, 348 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 26835 - protein, 581 aa, Homo sapiens
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 26836 - protein, 258 aa, Homo sapiens
MWSSVGSHVGPGPVGVAVAIMADPDPRYPRSSIEDDFNYGSSVASATVHIRMAFLRKVYSILSLQVLLTTVTSTVFLYFESVRTFVHESPALILLFALGSLGLIFALTLNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 26837 - protein, 515 aa, Homo sapiens
MAAYNGGTSAAAAGHHHHHHHHLPHLPPPHLHHHHHPQHHLHPGSAAAVHPVQQHTSSAAAAAAAAAAAAAMLNPGQQQPYFPSPAPGQAPGPAAAAPAQVQAAAAATVKAHHHQHSHHPQQQLDIEPDRPIGYGAFGVVWSVTDPRDGKRVALKKMPNVFQNLVSCKRVFRELKMLCFFKHDNVLSALDILQPPHIDYFEEIYVVTELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 26838 - protein, 417 aa, Umbelopsis vinacea
MITSFILASALALLPTQVLASNNGLAITPQMGWNTWNKYGCNIDEQLILDAAKAIVSSGLKDYGYNYVVIDDCWQKNERENNKTLLPDPTKFPRGMKPLVDDIHAMGLKVGIYSSAGTLTCGGHIASLGYEEIDAKTWASWGMDYLKYDNCYNQGQSGTAKLSYDRYNVMSQALNKTGRPILYSLCNWGEDGPWNFASTIGNSWRLSGDIYDNFNRPDPACPCETYDCLLPGFRCSVMNIINKSVAVAQKARSGGWNDMDMLEVGNGGMTHEEYRLHYTMWAALKSPLLLGNDVTNMTAQTKEIIMNDEVIAVNQDSSYSPAVRMWVKGDQQMFSGSLANNTQVVILLNAGDNETKMTATWDDIWFYSLPNVDSSKSIEVRDLWQKKNLGKFSHQITLDVPAHGVRMVKFMGSAQSS

SEQ ID NO: 26839 - protein, 180 aa, Echinochloa phyllopogon
PSGASTGIYEALELRDRPSDYLGKGVLKAVDNVNSIIGPAIYGKEPTEQVDIDNLMVQQLDGTSNEWGWCKQKLGANAILAASLAAVKAGSMVKIPLYQHIANLAGNKKIVLPVPALNVINGGSHAGNKLAMQEFMILPTGVSSFKEPMKMGVEVYHNLKSIIKKKYGQDATNVGDEGGF

SEQ ID NO: 26840 - protein, 432 aa, Mus musculus
MSDKLPYKVADIGLAAWGRKALDIAENEMPGLMRMREMYSASKPLKGARIAGCLHMTVETAVLIETLVALGAEVRWSSCNIFSTQDHAAAAIAKAGIPVFAWKGETDEEYLWCIEQTLHFKDGPLNMILDDGGDLTNLIHTKYPQLLSGIRGISEETTTGVHNLYKMMSNGILNVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYWLKNGRRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 26841 - protein, 434 aa, Beta vulgaris
MDRYKLLKELGDGTCGTVYKAVNRESYEIVAVKKMKRKFYFWEECVNLREVKSLPSIESSHIIKLKEVVRENNDLFFIFEYMQYNLYQIMKDRHRPFTEEEIRNFLTQVLQGLAHMHRNGYFHRDLKPENLLVTNDVIKIADFGLAREVSSIPPYTEYVSTRWYRAPEVLLKSSLYTPAIDMWAVGAVLAELFTSCPIFPGESETDQLYKICCVLGAPDWAVFPEAKNISQLTSISYSQMLPANLSEIIPNANWEAIDLISQLCSWDPLKRPTAEQALHHPFFHVALRVPRPIHDPFHSKPDYTKTKPNLELNLWDFDSKADDCFLGLTLAVNPGVSSLEMGPRVSGSTRQDVYFCSSFQDHPEQSVFWSLFSPCRNGATPPVDPSLSLSFSSITHPRIAVPHSGGFGLAALQPGILDGPLLVVSSPHQPSHYL

SEQ ID NO: 26842 - protein, 409 aa, Medicago truncatula
MAIPKLVPGFRFSPTGVELIKYFLKRKVMGKKVLNDVIAELDIYKYAPWDLPDLSYLQNGDLEWYFFCPIEKKYGNGSRMNRATEIGFWKATGKDRAVQQNNQTVGMIKTLIFHTGKAPRGDRTDWVMHEYRLEDKDLADKGIVQDSYVICKVFQKEGPGPRNGAQYGRPFNEEDWSDDEVGTPFAEPAALAPTLPVTSNSFVLNDQNLHAIGYNGSISMPCQSGLVPSPDPANSCQTGLPPSPDPANSSQIGLTPSPDPVNSCQTGFMSSPDPSNSCQTGYMPYPDSANECQIGFMSPDPANSHQTGLVLSPPDPVNSHLTGLVPSPDPVDNSYLENQAVNTDNILSMLDMFNDNDILPEENIAEGALSTDFFEVWETWIAWDLLARMLTLAHTVWLLRVMTTWISWS

SEQ ID NO: 26843 - protein, 87 aa, Drosophila melanogaster
DKHWAFSDIRTGRLLTKVIDTAEVGLTTAQFHPDGLIFGTGTVDSQVKIWDLKEQSNVANFPGHTGPISAISFSENGYYLATVADDA

SEQ ID NO: 26844 - protein, 165 aa, Capsicum annuum
MASQREENVYMAKLAEQAERYEEMVEFMEKVVAALDGGDELTVEERNLLSVAYKNVIGARRASWRIISSIEQKEESRGNEDHVTSIKNYRSKIEIELTSICNGILKLLDSKLIGSAATGDSKVFYLKMKGDYYRYLAEFKTGAERKEAAENTLSLISLLRILLMP

SEQ ID NO: 26845 - protein, 759 aa, Vitis vinifera
MGVMGDAFTQLLIPVAALVGIGFALLQWLLVSKVKVSADSDLNNGYSDRLIEEEEEGIDHEDVAAKCAEIQNAISVGATSFLFTEYRYLSIFMGVFGAIIFLFLGSVKGFSTKSEPCTYNTGSLCKPALANALFSTIAFLLGAMTSVFSGFLGMKIATYANARTTLEARKGVGKAFIVAFRSGAVMGFLLAASGLLVLYVSIHLFSLYYGDDWEGLYESITGYGLGGSSMALFGRVGGGIYTKAADVGADLVGKVERNIPEDDPRNPAVIADNVGDNVGDIAGMGSDLFGSYAEASCAALFVASISSFGISHDYTAMSFPLIISSVGIVVCLGTTLFATDFVEIKNVSEIEPSLKRQLLISTILMTAGIAVVSFFALPSEFTLFNFGSTKTVKNWHLFFCVSIGLWAGLVIGYITEYYTSNAYSPVQDVADSCRTGAATNVIFGLALGYKSVIIPIFAIAIAIYVSFSMAAMYGIAVAALGMLSTIATGLAIDAYGPISDNAGGIAEMAGMSHKIRQRTDALDAAGNTTAAIGKGFAIGSAALVSLALFGAFVSRAGIETVDVLTPKVFIGLIVGAMLPYWFSAMTMKSVGSAALKMVEEVRRQFNTIPGLMEGRAKPDYATCVKISTDASLREMIPPGALVMLTPLIAGTLFGVETLAGVLAGSLVSGVQVAISASNTGGAWDNAKKYIEAGASEHARSLGPKGSDPHKAAVIGDTIGDPLKDTSGPSLNILIKLMAVESLVFAPFFAAHGGLLFKLL

SEQ ID NO: 26846 - protein, 318 aa, Saccharomyces cerevisiae
RAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVKAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 26847 - protein, 415 aa, Pseudomonas aeruginosa
MDTFSYRDAELFAEGVALSRIAERFGTPTYVYSRAHIEAQYRAYADALAGMPHLVCFAVKANSNLGVLNVLARLGAGFDIVSRGELERVLAAGGDPAKVVFSGVGKTRDDMRRALEVGVHCFNVESGEELERLQRVAAELGVKAPVSLRVNPDVDAQTHPYISTGLKENKFGIAIDEAEAVYARAAELDHLEVIGVDCHIGSQLTQLEPFLDALERLLGLVDRLAGKGIGIRHLDLGGGLGVRYRDEQPPLAGDYIRAIRERLHGRDLTLVFEPGRSIVANAGVLLTRVEYLKHTEHKDFAIVDAAMNDLIRPALYQAWMDVQAVRPRDAAPRRYDLVGPICETGDFLAKDRDLALAEGDLLAVRSAGAYGFVMSSNYNTRGRAAEVLVDGQQTHEVRRRETVEELYAGESLLPQ

SEQ ID NO: 26848 - protein, 327 aa, Zea mays
SKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWLKFMNADNQHLVSPEAIDFLDKLLRYDHQERLTALEAMTHPYFQQVRAAENS

SEQ ID NO: 26849 - protein, 272 aa, Homo sapiens
VRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 26850 - protein, 182 aa, Homo sapiens
  unsure (1)..(182): unsure at all Xaa locations
XSSSEEVSWISWFCGLRGNEFFCEVDEDYIQDKFNLTGLNEQVPHYRQALDXILDLEPDEELEDNPNQSDLIEQAAEXLYGLIHARYILTNRGIAQXLEKYQQGDFGYCPRVYCENQPXLPIGLSDIPGEAXVKLYCPKCXDVYTPKSSRHHHTDGAYFGTGFPHXLFXVHPEYRPKRPANQ

SEQ ID NO: 26851 - protein, 273 aa, Mus musculus
AARRALIVLAHSEKTSFNYAMKEAAVEALKKRGWEVLESDLYAMNFNPIISRNDITGELKDSKNFQYPSESSLAYKEGRLSPDIVAEHKKLEAADLVIFQFPLQWFGVPAILKGWFERVLVAGFAYTYAAMYDNGPFQNKKTLLSITTGGSGSMYSLQGVHGDMNVILWPIQSGILRFCGFQVLEPQLVYSIGHTPPDARMQILEGWKKRLETVWEETPLYFAPSSLFDLNFQAGFLLMKEVQEEQKKNKFGLSVGHHLGKSIPADNQIKARK

SEQ ID NO: 26852 - protein, 498 aa, Fundulus heteroclitus
METILNVLGLGWIDSRSILIFLFVFLLLADVLKNRVPRNFPPGPWSFPLVGDLPRIEASKIHLQFKEFAGKYGNVFSLRLFGGRIAIINSYKFMTEALVQRGEDFTDRPSIPLFEDVFGNRGLVGSSGYPWKQQRRFALHTLRNFGLGKKTLERSIQQECQYLTEAFADQQGQPFNAQKLINNAVSNIICCLVFGNRFEYSDKQFQTILQLLNETLYLEGTVWAQMYNTMPWLMRWLPGPHQRIFSITNELRSFVKVRINEHRENLDPSSPRDYIDSFLIEMGEKEDKDSGFDLDNLCFCVLDLFVAGTETTTTTLHWGLLYMICNPQIQERVQAEIDAVIGPSRPPSMSDRDNMPYTDAVIHEIQRMGNIIPLNVARMANKDTTVDQYTIPKGTMNLATLDSVLHDESMWETPNTFNPEHFLEKDGTFRKREAFLPFSAGKRVCLGEQLARMELFLFFTSLLQRFKFSPPPGEQPSLEYKLGVTHCPKPYRLCAVSR

SEQ ID NO: 26853 - protein, 341 aa, Sporothrix schenckii
MDNYQKLEKVGEGTYGVVYKARDLTAGGRIVALKKIRLEAEDEGVPSTAIREISLLKEMRDPNIVRLYNIVHAEGHKLYLVFEFLDLDLKKYMDSLPVSDGGRGKALPEGTGTRLHTLGLGDDIIKKFMSQLCAGIRYCHSHRILHRDLKPQNLLINKEGNLKLADFGLARAFGVPLRTYTHEVVTLWYRAPEILLGGHQYSTGVDMWSVGCIFAEMAMRKPLFPGDSEIDEIFKIFRLLGTPTEDVWPGVTTYPDFKASFPRWVQDTETPICPTLDPMGQELLELMLVYDPASRLSAKQACNHPYFDDLEKALPGTAAAAARQHTTTAAAGGAYNGSGYH

SEQ ID NO: 26854 - protein, 579 aa, Arabidopsis thaliana
MDESSANSRVSMNGNLYWTAYNSKTVMEQCKRTREIEIWVTKNKIGNGDDGNDVVWIKFMTVSIPNFPMVLCHNSTSYFVDDSISGKSFVLCFSTKKPKQAWVYIVRGDLCKKIKIDEVVFLKAIEITIPISRFVFKSWVDEISLLVGGLSLVAVVSITNRNISLHKMPLSRSLLSRRISNSFRFHQGETTTAPESESIPPPSNMAGSSSWSAMLPELLGEIIRRVEETEDRWPQRRDVVTCACVSKKWREITHDFARSSLNSGKITFPSCLKLPGPRDFSNQCLIKRNKKTSTFYLYLALTPSFTDKGKFLLAARRFRTGAYTEYIISLDADDFSQGSNAYVGKLRSFKFVLRFVFFCLEDECGLKTKGSWFFFGNFNRSDFLGTNFTVYDSQPPHNGAKPSNGKASRRFASKQISPQVPAGNFEVGHVSYKFNLLKSRGPRRMVSTLRCPSPSPSSSSAGLSSDQKPCDVTKIMKKPNKDGSSLTILKNKAPRWHEHLQCWCLNFHGRVTVASVKNFQLVATVDQSQPSGKGDEETVLLQFGKVGDDTFTMDYRQPLSAFQAFAICLTSFGTKLACE

SEQ ID NO: 26855 - protein, 473 aa, Pseudomonas aeruginosa
MAAKVLLVEDDRALREALSDTLLLGGHEFVAVDSAEAALPVLAREAFSLVISDVNMPGMDGHQLLGLIRTRYPHLPVLLMTAYGAVDRAVEAMRQGAADYLVKPFEARALLDLVARHALGQLPACEEDGPVALEPASRQLLELAARVARSDSTVLISGESGTGKEVLANYIHQQSPRAGKPFIAINCAAIPDNMLEATLFGHEKGSFTGAIAAQPGKFELADGGTILLDEISEMPLGLQAKLLRVLQEREVERVGARKPINLDIRVLATTNRDLAAEVAAGRFREDLYYRLSVFPLAWRPLRERPADILPLAERLLRKHSRKMNLGAVALGPEAAQCLVRHAWPGNVRELDNAIQRALILQQGGLIQPADLCLTAPIGMPLAAPVPVPMPAMPPATPPSVEIPSPAAGQDASGALGDDLRRREFQVIIDTLRTERGRRKEAAERLGISPRTLRYKLAQMRDAGMDVEAYLYAI

SEQ ID NO: 26856 - protein, 530 aa, Drosophila melanogaster
MVGTTLKMRGDENASENFKQVQLKKLTVPSMEATTKRAALGDLQNRGISRPIAAKDAAQKDSKDLKLTDALRNAKARVDSHWKKQPLGSTNGNGNGAVPPKVNEGGVSAFLRSNSVRNRVPTKTTVEPTKVTVKSSSSENVNEPTLKREDSNLSKKSLTKLRAALAKPVMGVSGIRREPVAVSRKEAETKKELPETKKDSLEVKKDATRMPLIRGNSAVTTTTSTMPTTMSLSSKRLAGIEDIDANDKENLVLVSEYVNDIYDYLYQVELEQPIHKDHLAGQKEVSHKMRAVLIDWINEVHLQFHLAAETFQLAVAIIDRYLQVVKDTKRTYLQLVGVTALFIATKYEELFPPAIGDFVFITDDTYTARQIRQMELQIFKAINCNLSRPLPIHFLRRYSKAAGAEDEHHTMSKYFIELASVDYEMATYRPSEIAAASLFLSLHLLNGNHRAGTGFNDRHWTPTLTFYSRYSAAHLRPITRLIAKLARDAPQAKLKAIYNKYQGSKFQKIALRTEPTGALMDSIVGQSQRK

SEQ ID NO: 26857 - protein, 302 aa, Cavia sp.
MGSWTKCQSCLAPGLLQNRAAIVTGGGTGIGKAIAKELLHLGCNVVIASRKFDRLRAAAEELKATLPPSNKAEVTPIQCNIRKEEEVNNLMKSTLALYGKIDFLVNNGGGQFWSSPEHISSKGWHAVIETNLTGTFYMCKAAYNSWMKEHGGAIVNIIILLNGQPFVAHSGAARGGVYNLTKSLALGWARSGIRINCVAPGTVYSQTAMDNYGDMGKTLFADAFQKIPAKRLGVPEEVSSLVCFLLSPAASFITGQLVNVDGGQSLYCQNHDIPDHDNWPEGVGDLSTVKKMKESFKQKAKL

SEQ ID NO: 26858 - protein, 303 aa, Mus musculus
MGSWKTGQSYLAAGLLKNQVAVVTGGGTGIGKAVSRELLHLGCNVVIASRKLDRLTAAVDELRASLPPSSSAEVSAIQCNIRKEEEVSNLVKSTLAKYGKINFLVNNGGGQFMAPVEDITAKGWHAVIETNLTGTFYMCKEVYNSWMREHGGSIVNIIVLLNNGFPTAAHTGAAREGVYNLTKSMALAWASSGVRINCVAPGTIYSQTAVDNYGEMGQTLFEMAFDSIPVSALGVPEEISLLARFLLSPAASYITGQLINVDGGQALHTHAFSIPDHDNWPVGAGDLSIVKRIKESFKKKAKL

SEQ ID NO: 26859 - protein, 938 aa, Drosophila melanogaster
MSTAMRTTLQSVPEALPADSVSNGTASNVAAPAAPVSSATNAVPPLAAVSSTTATYATNSISTSSHSVKDQQQQQQQQQHDSANANIVSLPPTTTPVANTNTMMPIVTSSNSATSNSTAATPTPASGAAATGGVGSVSQGPATVSASAANTNHSHQHSHQHHHHVANNMTTDGARLSSNNSAVVASSAINHHHHHTPGSGVAPTVNKNVLSTHSAHPSAIKQRTSSAKGSPNMQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIEALVAMGYNRSEIEASLSQVRYDDVFATYLLLGRKSTDPESDGSRSGSSLSLRNISGNDAGANAGSASVQSPTHRGVHRSISASSTKPSRRASSGVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETNLFDRLRMASAVKSSRHFPRNVPSRSTFHSGQTRARNNTALEYSGTSGASGDSSHPGRMSFFSKLSSRFSKRPTIADEAAKPRVLRFTWSMKTTSPLMPDQIMQKIREVLDQNNCDYEQRERFVLWCVHGDPNTDSLVQWEIEVCKLPRLSLNGVRFKRISGTSIGFKNIASRIAFDLKL

SEQ ID NO: 26860 - protein, 615 aa, Arxula adeninivorans
MKLLSLVPMALAAVATAKTVEYDFHVNWTTANPDGLYERKVIGINGQWPLPRIEVDKGDRLVVNMYNDMPDRNASIHFHGMYQNGTNYMDGPVGVTQCPVPPGGKFTYNFTVDQNGTYWYHSHVDGQYPDGYRAPFIVHDKNFPYDYDEELVLTMSDWYHDLIDYLNKEEFLTLYNPTGAEPVPQAMLFNDTQKLSVSVKPNTTYLVHLMNIGALGAQYFYIEDHNVTVVEIDGVYTEPAETDILYLAVAQRYTFLLKTKDTTDKNYPMVSIFDENLFDVIPSDLGMNMTNWLEYNSDADHPEADIPWESSVDIEYFDDMDLVPYDHKPLYTNVSKRIELEVVMTNLDNGVNYAFFNNITYTAPKVPTLMTALSAGDLVTNELVYGEYTHTVVVNHLDVVEIVVNNNDAGFHPFHLHGHEFQVVERSPEYEGFVPYNPDNHTDSDFAEYPMRRDTAWVPPNGNMVLRFVADNPGAWFFHCHIDWHLTQGLAMVFVEAPEKLKDMTLPQSHKDTCDAVGMPWKGNAAANDDDFLDLTGQNAQAPDLPAGFTARGIVALVFSCISAFLGMGMITWYGLSDISNTERKVLEREGVISEGEQVDPIDPSTVAHPHHHEN

SEQ ID NO: 26861 - protein, 90 aa, Lupinus luteus
EETTTGVKRLYQMQANGTLLFPAINVNDSVTKRQFDNLYGCRHSLPDGLMRATDVMIAGKVAVVAGYGDVGKGCASALKQAGARVIVTEI

SEQ ID NO: 26862 - protein, 261 aa, Streptomyces galilaeus
MPPASERVAIVTGATSGIGLAVARSLAEGGARVFICARDGDRVAHTVKELREAGHDVDGASCDVRDTARVRAFVQEARDRFGPVDALVNNAGRSGGGHTAQIADELWLDVIETNLNSVFRMTREVLTTGGMLERGAGRIVNIASTGGKQGVALGAPYSASKHGVVGFTKALGLELAKTGITVNAVCPGYVETPMAERVRQGYAGAWDITEDEVLERFEAKIPLGRYSTPDEVAGLVGYLLSSTAASITAQAMNVCGGLGNY

SEQ ID NO: 26863 - protein, 165 aa, Cichorium intybus x Cichorium endivia
MSFSEEQEALVKEAWEIMKEDIPALSLYFFTQVLEIAPAAKGLFSFLKDAEEIPQDNPKLKSHAVKVFKMTCEAIQLREKGEVVVSGSTLKYLGSVHLQKGVIDAHFAVVKEGVLRTVEKGVGEKWSEEMKGAWSEAYDQLAAAIITEMKKEATEMDEEAEETQT

SEQ ID NO: 26864 - protein, 1092 aa, Adiantum capillus-veneris
MSTSSSMNDQRRDAYSLRAPPNEGKLHPLARDSRGSLEVFNPGNPSSLTAASIGAGMQYTPSWQQQQPPEDENYDLPLNQREKEENIYNQTHGGPERERGPDKGTSPSDHKRGMSTGTSPPTRSKYSEIFTSHDTIDKEGKFQAYQTNEESTHDWLSSTPAGQGPMLGGGFGGGEGARGSYLLGTREHPKARCDSLAERAAGWGLVLKTDGDSGRVDGVRTRTSEEEREFRRLSEERRSLNSSTVRTSDDSGFTSDTSNASRIPRVSKDVLQALEGFQQTFVIADGTKPDLPIMYASAGFFKMTGYTSSEVIGRNCRFLQGKETDPEEIDRIRECISKGSGYCGRLLNYKKDGSAFWNLLTISPIKDVDGSVLKYIGMQVEVSQFTEGTKENAMRPNGLSESLIKYDARQKERASFQVTELVEAIKDPKQVGDDKKTSISLGVVRPVAPSGPRKGPDLRELLTAQQYTPRSATSVQPKGSNLTEPGSHRESISKRNRSSGFFSFLGLDKLAGKGPGNQHDAAEFIEPEILMTKDEDSSEASFELDKARLKEIRRGIDLATTLERIEKNFVITDPRLPDNPIIFASDNFLELTEYSREEILGRNCRFLQGPDTNRETVKLIRDAIDNEKEVTVQLLNYTKTGRTFWNLFHLQPMRDHKGELQYFTGVQLDGTEYLEPLTKRLSQQIASEGAKIIRETAANVNEALRELPDANLKVEDLWRIHSRLVLPKPHKLNHDSWGVIRKIHASGEKVKLKHFRPLRPLGYGDTGSVHLVELRGTGKLFAMKAMEKNVMVKRNKVHRVCAEREILGMMDHPFLPTLYASFETQTHVCLITDFCAGGELFLLLERQPTKIFREETARFYTSEVVVALEYLHCQGVIYRDLKPENILLQQDGHVMLSDFDLSYLSSSNPRLVVPPRLHKKRSKRKNFPPPIFRAEPIGACNSFVGTEEYIAPEVITGSGHNSSVDWWALGILMYEMLYGRTPFRGKTRQKTFGNILHKDLVFPRRIPTSLAARQLINGLLQKDPENRLGSQGGANEIKGHPFFQGVNWTLIRCMRPPTFDAPVCFAGSELDVEGDEALDWDDVEASNPIEYF

SEQ ID NO: 26865 - protein, 348 aa, Methylococcus capsulatus
MQRVHTITAVTEDGESLRFECRSDEDVITAALRQNIFLMSSCREGGCATCKALCSEGDYDLKGCSVQALPPEEEEEGLVLLCRTYPKTDLEIELPYTHCRISFGEVGSFEAEVVGLNWVSSNTVQFLLQKRPDECGNRGVKFEPGQFMDLTIPGTDVSRSYSPANLPNPEGRLEFLIRVLPEGRFSDYLRNDARVGQVLSVKGPLGVFGLKERGMAPRYFVAGGTGLAPVVSMVRQMQEWTAPNETRIYFGVNHEPELFYIDELKSLERSMRNLTVKACVWHPSGDWEGEQGSPIDALREDLESSDANPDIYLCGPPGMIDAACELVRSRGIPGEQVFFEKFLPSGAA

SEQ ID NO: 26866 - protein, 805 aa, Solanum tuberosum
MAERVLTRVHSLRERVDATLAAHRNEILLFLSRIESHGKGILKPHELLAEFDAIRQDDKNKLNEHAFEELLKSTQEAIVLPPWVALAIRLRPGVWEYIRVNVNALVVEELSVPEYLQFKEELVDGASNGNFVLELDFEPFTASFPKPTLTKSIGNGVEFLNRHLSAKMFHDKESMTPLLEFLRAHHYKGKTMMLNDRIQNSNTLQNVLRKAEEYLIMLPPDTPYFEFEHKFQEIGLEKGWGDTAERVLEMVCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRIEKVYGAEHSHILRVPFRTEKGIVRKWISRFEVWPYMETFIEDVAKEISAELQAKPDLIIGNYSEGNLAASLLAHKLGVTQCTIAHALEKTKYPDSDIYWKKFDEKYHFSSQFTADLIAMNHTDFIITSTFQEIAGSKDTVGQYESHMAFTMPGLYRVVHGINVFDPKFNIVSPGADINLYFSYSETEKRLTAFHPEIDELLYSDVENDEHLCVLKDRTKPILFTMARLDRVKNLTGLVEWYAKNPRLRGLVNLVVVGGDRRKESKDLEEQAEMKKMYELIETHNLNGQFRWISSQMNRVRNGELYRYIADTKGAFVQPAFYEAFGLTVVEAMTCGLPTFATNHGGPAEIIVHGKSGFHIDPYHGEQAADLLADFFEKCKREPSHWETISTGGLKRIQEKYTWQIYSERLLTLAAVYGFWKHVSKLDRLEIRRYLEMFYALKYRKMAEAVPLAAE

SEQ ID NO: 26867 - protein, 84 aa, Bombyx mori
HPGLQPRMRAILLDWLIEVCEVYKLHRETFYLAVDYLDRYLHVATVQKTHLQLIGIHPASLLLVDHKVQKTHLQLIGITCLFVA

SEQ ID NO: 26868 - protein, 287 aa, Bombyx mori
MANNDNFAQDITTDNQLNGNAENGGGDSQDHNSAEAPGRDDDRKLFVGGLSWETTDKELRDHFGAYREIESINVKTVPNTGRSRGFAFIVFKAPESIDKVMAAGEHTINNKKVDPKKAKARHGKIFVGGLSSEISDDEIRNFFSEFGTILEVEMPFDKTKNQRKGFCFITFESEQVVNDLLKTPKRTIGGKEVDVKRATPKPDGPGGIGTRGGRGGRGARGGRGGRGGYGGQPWGNQGYGGYGYGQGGYGGGYDSYGYGGYGYDGYGGYGGYDYSGYPNYGKRGKQY

SEQ ID NO: 26869 - protein, 436 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRREVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTLLFSR

SEQ ID NO: 26870 - protein, 359 aa, Hydrogenophilus thermoluteolus
MSWAHTPTLTQYLIEERRRYPQASGDFNALILDMARACKAIARQVAYGALAKSNHAVTTTINVQGEEQKPLDVISNECFMRLTEWGGYLAAMASEEMDEPYLIPEQYPRGRYLLLFDPLDGSSNIDVNVSVGSIFSVLRAPEGKTEITVDDFLQPGTQQVAAGYAIYGPTTMLVLTVGRGVVGFTLDPDFGEFMLTHPNIRIPESTKEFAINTSNARFWEPPVKRYVDECLKGKTGPRGKDFNMRWVASLVAETHRILSRGGVFLYPRDNKEPKKPGRLRLLYECNPIGMIVEQAGGRASTGYGPVLEVQPTELHQRIGFVFGSREEVERIEQYHNDPDASPVDLPLFAERTLFRDETL

SEQ ID NO: 26871 - protein, 249 aa, Spodoptera littoralis
MFANKVVLVTGGSSGIGAATVEAFVKEGASVAFVGRNQAKLKEVESRCQQHGANILAIKADVSKDEEAKIIVQQTVDKFGKLDVLVNNAGILRFASVLEPTLIQTFDETMNTNLRPVVLITSLAIPHLIATKGSIVNVSSILSTIVRIPGIMSYSVSKAAMDHFTKLAALELAPSGVRVNSVNPGPVLTDIAAGSGFSPDLLEDTGAHTPLGKAAQSEEIADMIVYLASDKAKSVTGSCYIMDNGLALQ

SEQ ID NO: 26872 - protein, 97 aa, Plasmodium falciparum
MKNTGKEVRKRRKKKKDPHAPKRSLSAYMFFAKEKRAEIISKQPELSKDVATVGKMIGEAWNKLGEKEKAPFEKKAQEDKLRYEKEKAEYANMKMKA

SEQ ID NO: 26873 - protein, 521 aa, Candida albicans
MVFETSKATSYLKDYPKKDGLSVKELIDSTNFGGLTYNDFLILPGLVNFPSSAVSLETKLTKKITLKSPFVSSPMDTVTEENMAIHMALLGGIGIIHHNCTAEEQAEMVRKVKKYENGFINDPVVISPEVTVGEVKKMGEVLGFTSFPVTENGKVGGKLVGIITSRDIQFHEDNKSPVSEVMTKDLVVGKKGISLTDGNELLRSSKKGKLPIVDAEGNLVSLISRTDLQKNQDYPNASKSFHSKQLLCGAAIGTIDADRERLDKLVEAGLDVVVLDSSNGSSVFQLNMIKWIKEKYPELQVIAGNVVTREQAALLIEAGADALRIGMGSGSICITQEVMACGRPQGTAVYGVTEFANKFGVPCIADGGIGNIGHITKALALGASCVMMGGLLAGTAETPDDYFYRDGKRLKTYRGMGSIDAMQQTNTNANASTSRYFSEADKVLVAQGVSGSVVDKGSITKFVPYLYNGLQHSLQDIGIKSIDELRENVDNGEIRFEFRTASAQFEGGVHGLHSYEKRLHN

SEQ ID NO: 26874 - protein, 139 aa, Arabidopsis thaliana
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 26875 - protein, 139 aa, Arabidopsis thaliana; identical to SEQ ID NO: 909

SEQ ID NO: 26876 - protein, 283 aa, Mus musculus
MAGNFWQSSHYLQWILDKQDLLKERQKDLKFLSEEEYWKLQIFFTNVIQALGEHLKLRQQVIATATVYFKRFDARYSLKSIDPVLMAPTCVFLASKVEEFGVVSNTRLIAATTSVLKTRFSYAFPKEFPYRMNHILECEFYLLELMDCCLIVYHPYRPLLQYVQDMGQEDVLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 26877 - protein, 298 aa, Mus musculus
MENFQKVEKIGEGTYGVVYKAKNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 26878 - protein, 153 aa, Mus musculus
MSSEEGKLFVGGLNFNTDEQALEDHFSSFGPISEVVVVKDRETQRSRGFGFITFTNPEHASDAMRAMNGESLDGRQIRVDHAGKSARGSRGGAFGGRGRSYSRGGGDQGYGSGRYDSRPGGYGYGYGRSRDYSGSQGGYDRYSGGNYRDNYDN

SEQ ID NO: 26879 - protein, 102 aa, Lactococcus lactis
MLYGKENRDEAEFLEPIFGSESEQVDLPKYKLAQQSIEPRVAYQLVQDEMLDEGNARLNLATFCQTYMEPEAVKLMSQTLEKMRLINRNIQEQLKLKTVAST

SEQ ID NO: 26880 - protein, 105 aa, Lactococcus lactis
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIA

SEQ ID NO: 26881 - protein, 157 aa, Lactococcus lactis
FVDPELEWDFRLKNVISINTSGHKYGLVYTGVGWVLWRDKKYLPEELIFKVSYLGGELPTMAINFSHSASQLIGQYYNFVRYGFDGYKAIHERTHKVAMYLAEEIEKTGMFEIMNDGSQLPIVCYKLKENSNLGWNLYDLADRLFNEGMASACLSTS

SEQ ID NO: 26882 - protein, 713 aa, Artemisia annua
MALSAFAFPTQINHRSVTSNQPLIQHCLFGTDLNSSQKPFNQIVKRSNGIRSTLSERGEYHSQRPPTPLLDTINYPIHMKNLSVKELKQLADELRSDVIFNVSKTGGHLGSSLGVVELTVALHYVFNTPQDKILWDVGHQSYPHKILTGRRDQMHTIRQTNGLAGFTKRSESEHDCFGTGHSSTTISAGLGMAVGRDLKGGTNDVVAIIGDGAMTAGQAYEAMNNAGYLDSDMIVILNDNKQVSLPTANLDGPIPPVGALSSALSRLQSNRPLRELREVAKEVTKQIGGPMHELAAKVDEYARGMISGSGSTLFEELGLYYIGPVDGHSIDDLVAILKEVKSTKTTGPVLIHVITEKGRGYPYAEKAADKYHGVGKFDPATGKQFKSSAPTQSYTTYFAEALIAEAEADKKIVGIHAAMGGGTGMNLFLRRFPTRCFDVGIAEQHAVTFAAGLACEGLKPFCAIYSSFLQRGYDQVVHDVDLQKLPVRFAMDRAGLVGADGPTHSGSFDVTFMACLPNMVVMAPSDEAELFNMVATAAAIDDRPSCFRYPRGNGIGVPLPPGNKGVPLEVGKGRIMLEGQRVALLGYGTAVQSCMAAATIVQERGLNITVADARFCKPLDHSLIRALAKTHEVLITVEEGSIGGFGSHVAHFLALDGLLDGNLKWRPLVLPDRYIDHGAPADQLAEAGLTPSHIAATVFNVLGQTREALEVMS

SEQ ID NO: 26883 - protein, 262 aa, Bacillus megaterium
MYKDLEGKVVVITGSSTGLGKSMAIRFATEKAKVVVNYRSKEDEANSVLEEEIKKVGGEAIAVKGDVTVESDVINLVQSAIKEFGKLDVMINNAGMENPVSSHEMSLSDWNKVIDTNLTGAFLGSREAIKYFVENDIKGTVINMSSVHEWKIPWPLFVHYAASKGGMKLMTETLALEYAPKGIRVNNIGPGAINTPINAEKFADPEERADVESMIPMGYIGEPEEIAAVAWLASSEASYVTGITLFADGGMTQYPSFEAGRG

SEQ ID NO: 26884 - protein, 263 aa, Bacillus megaterium
MYKDLEGKVVVITGSSTGLGKSMAIRFATEKAKVVVNYRSKEDEANSVLEEEIKKVGGEAIAVKGDVTVESDVINLVQSAIKEFGKLDVMINNAGMENPVSSHEMSLSDWNKVIDTNLTGAFLGSREAIKYFVENDIKGIVINMSSVHEWKIPWPLFVHYAASKGGMKLMTETLALEYAPKGIRVNNIGPGAINTPINAEKFADPEQRADVESMIPMGYIGEPEELAAVAAWLASSEASYVTGITLFADGGMTQYPSFEAGRG

SEQ ID NO: 26885 - protein, 376 aa, Helobdella robusta
GTRVTAANSRSFKSNNNASSISNSSSIGRSHYDIYDDDDDDDDNDIPSTFNDLDISFEGRRMSSTTIFEHHQQQQQKQHIPTEVAARQHRRSLINQQIALLDVYSLPEYRDDILTYGKEAEQRYMAKANYMERQSDINHSMRSILVDWLVEVADEYKLKRETFFLAVNYIDRFLSMMSVIRCRLQLLGAAAMFIAAKYEEIYPPDVAEFVYITDDTYTMKQVLQMEQAILKTLNFLVAAPTPNYFCCDLLDRLGAYKKGPNGVCDDGGRWNSLAMYMLETTTVFGDCFLKFSPSMISTSCVALSHYLINMTGCMSELSRITSYTVFSLSECLNSIFTTLHNSPNVPQQALRVKYNSEKYHFVASLELPETLPLDLL

SEQ ID NO: 26886 - protein, 346 aa, Mus musculus
MENFQKVEKIGEGTYGVVYKAKNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMHLVCTQHHAKCCGEHRRNGRHSLCPLCSYLEVAASQGGGMTAVSAPHPVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 26887 - protein, 259 aa, Picea glauca
MVESSREENVYMAKLAEQAERYEEMVEFMEKVTKGVEVEELTVEERNLLSVAYKNVIGARRASWRIISSIEQKEESRGNDEHVVTIREYRSKVESELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFGEAIAELDTLGEDSYKDSTLIMQLLRDNLTLWTSDMQEDAGDEIKETSKRDEGEEQ

SEQ ID NO: 26888 - protein, 406 aa, Rattus norvegicus
MAAAAAAPGGGGGEPRGTAGVVPVVPGEVEVVKGQPFDVGPRYTQLQYIGEGAYGMVSSAYDHVRKTRVAIKKISPFEHQTYCQRTLREIQILLGFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEVSRPPAAGRGISVPSVRPVPYCLCPQPVAEEPFTFDMELDDLPKERLKELIFQETARFQPGAPEAP

SEQ ID NO: 26889 - protein, 324 aa, Drosophila virilis
MSVEDEVFRIQKKIGKISTSSDGAGQDQALDLLKALQTLNINLEILTKTRIGMTVNELRKSSKDDEVIALAKTLIKNWKRFLASPAPPGTPKESAGSKESNNSNSGSSATKSSSATKSNSSSGKDKSSSSSSSTSAISTKDKREEKKPAAAQTTFPAGGMTDAVRLKCREMLANALKIGEVPDGCAEPEEMAAELEEAIYMEFKNTDMKYKNRIRSRVANLKDPKNPGLRSNFMCGAVSAKQLAKMTPEEMASDEMKKLREKFVKEAINDAQLATVQGTKTDLLKCGKCKKRNCTYNQLQTRSADEPMTTFVMCNECGNRWKFC

SEQ ID NO: 26890 - protein, 367 aa, Homo sapiens
FRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTT

SEQ ID NO: 26891 - protein, 396 aa, Streptomyces coelicolor
MRGGQRRASRLRPPTYRRRPPPAASILEVAPVQTQTLTQTDTAAGGAEPDAERGVLLAMPAQPGAGAALPHPGAPVDVPEHPEPPPPTRTESGGPSSDLFRQYLREIGRIPLLSAAEEVDLARRVEAGLFAEEKLRCSPGLDDRLALDLDRLVVLGRLAKRRLIEANLRLVVSVAKRYVGRGLTMLDLVQEGNLGLIRAVEKFDYARGYKFSTYATWWIRQAMSRALADQARTIRVPVHVVELINRVVRVQRRMLQERGCEPTPQEVAAHLDLAPERVGEVLRLAQEPVSLHAPVGEEDDVALGDLIEDGDAASPVESAAFLLLRQHLEAVLSTLGERERKVVQLRYGLADGRPRTLEEIGRLGGVTRERIRQIESKTLSKLRDHAYADQLRGYLD

SEQ ID NO: 26892 - protein, 332 aa, Caenorhabditis elegans
MDPIREGEVAHEGDSVYTLNDFTKLEKIGEGTYGVVYKGKNRRTNAMVAMKKIRLESEDEGVPSTAVREISLLKELQHPNVVGLEAVIMQENRLFLIFEFLSFDLKRYMDQLGKDEYLPLETLKSYTFQILQAMCFCHQRRVIHRDLKPQNLLVDNNGAIKLADFGLARAIGIPIPVYTHEVVTLWYRAPEILMGAQRYSMGVDMWSIGCIFAEMATKKPLFQGDSEIDELFRIFRVLGTPTELEWNGVESLPDYKATFPKWRENFLRDKFYDKKTGKHLLDDTAFSLLEGLLIYDPSLRLNAKKALVHPYFDNMDTSKLPAGNYRGELELF

SEQ ID NO: 26893 - protein, 909 aa, Pseudomonas tolaasii
MLRRMGIKGRVLLLTLLPTTLMALLLGGYFTWMQLSELQTQLLQRGEMIAEQLAPLVAPALSTRNTDLLERIATQSLEQPDVRAVSFLAPDRSPLAHARPTMLNQPPVGNSSHLVAASGNDATRYLLPVFGRHRNLAGELIPDEADRLLGWVEVELSHNGMLLRGYRSLFASLLLIAIGLICTAALAVRISRTINSPIGQIKQPVAQLKDGNLETCLAPLGSQELDQLASGINRMAETLQNAQEELQHSIDQATEDVRQNLETIEIQNIELDLARKEALEASRIKSEFLANMSHEIRTPLNGILGFTHLLQKSELSPRHVDYLGTIEKSADNLLGIINEILDFSKIEAGKLVLDSVPFNLRDLLQDTLTILAPAAHAKQLELVSLVYRDTPLAVVGDPLRLKQILTNLISNAIKFTREGTIVARAMVEDEEEDSVQLRISVQDTGIGLSNQDVRALFQAFTEADNSLSRQPGGTGLGLVISKRLIEQMGGEIGVDSTPGEGSEFWISLNLPKTRDDVDDLPSAPLLGRRVAVLENHDVARQALQHQLEDCGLEVTPFNTLESLTNGITSTHQTEQAIDLAVLGVTANDIPPERLNQHLWDLEHLGCKVLVLCPTTEQMLFNQSVPNPNSQLQAKTPCTRKLRRALADLISPPVAQRTREPLSSRAPRVLCVDDNPANLLLVQTLLEDMGAKVLAVESGYAAIDAVKQETFDLVLMDVQMPGMDRRQSTEAIRQWESERHGTPLPVVALTAHAMANEKRALLQSGMDDYLTKPISERQLAQVVLKWTGLALRNQGPERGNDNLGHGVQLLVLDHEEGLAAANKADLAADMLAMLLASLEADRLAITVAREAKDNNALIERIHRLHGATRYCGVAELRAACQRAETLLKQDDAQGHGALDELDMAIGAAGQ

SEQ ID NO: 26894 - protein, 335 aa, Sus scrofa
TDQAAFDTNIVTLTRFVMEQGRKARGTGEMTQLLNSLCTAVKAISTAVRKAGIAHLYGIAGATNVTGDQVKKLDVLSNDLVINVLKSSFATCVLVTEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRNVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHA

SEQ ID NO: 26895 - protein, 128 aa, Lilium longiflorum
MISSANNKGAGTSRRKLRSEKAALQFSVSRVEYSLKKGRYCRRLGATAPVYLAAVLENLVAEVLEMAANVTEKHKRIVIKPRHIMLAVRNDVEVNKLFHGVTISASGVVPKTRKELDRRKRRSTSQAD

SEQ ID NO: 26896 - protein, 189 aa, Oryza sativa (japonica cultivar-group)
MEECKGGGMSPSSSMDSSTHPALSTTSSAATARRDLSTDLRLGLSLSTSSSSSLLQAAAAAAAADDSIPSTPRNSQVHADWPPIKPFLRSALQKASAAGGGGARRRRTLFVKVYMEGVPIGRKLDLLLLDGYDSLLIKLCHMFKTPITYADVMECHQQVPGQKAAHVLTYEDQDGDWMMVGDVPWEYVS

SEQ ID NO: 26897 - protein, 768 aa, Oryza sativa (japonica cultivar-group); identical to SEQ ID NO: 939

SEQ ID NO: 26898 - protein, 260 aa, Populus x canescens
MDSSKDRENFVYVAKLAEQAERYDEMVDAMKKVAKLDVELTVEERNLLSVGYKNVIGARRASWRILSSIEQKEESKGNETNVKRIKEYRKKVEAELTGVCNDIMTVIDEHLIPSSIPGESAVFYYKMKGDYYRYLAEFKSGNERKEAADQSLKAYETATSTAARDLSPTHPIRLGLALNFSVFYYEIMNSPERACHLAKQSFDEAISELDTLSEESYKDSTLIMQLLRDNLTLWTSDIPEDGEDQKMETSAKAGGGEDAE

SEQ ID NO: 26899 - protein, 261 aa, Populus x canescens
MAATPSAREESVYMAKLAEQAERYEEMVEYMEKVSASLENEELTVEERNLLSVAYKNVIGARRASWRIISSIEQKEESRGNEDHVSVIRDYRAKIETELSSICDGILKLLDSRLIPTASAGDSKVFYLKMKGDYHRYLAEFKTGAERKEAAESTLTAYKAAQDIANAELAPTHPIRLGLALNFSVFYYEILNSPDRACSLAKQAFDEAIAELDTLGEESYKDSTLIMQLLRDNLTLWTSDMQDDGADEIKEAAPKPGDEQQ

SEQ ID NO: 26900 - protein, 458 aa, Pyrus pyrifolia
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGILISYEGKVQLLEIAQVPEEHVDEFKSIEKFKIFNTNNLWVNLNAIKRLVDADALKMEIIPNPKEVNGVKVLQLETAAGAAIKFFDHAIGINVPRARFLPVKATSDLLLVKSDLYNVRDGFVIRNKLRRDPQNPVIQLGPEFKKVDDFLSRFKSIPSLLECDGLRVDGDIWFGSGIKLKGNVHCSVSSEEMLNIPDNITLRE

SEQ ID NO: 26901 - protein, 257 aa, Streptomyces virginiae
MTDRQGLLTDRIALITGASSGIGAAQRGLFAREGAAVVVTARREERLAGLVDELRAQGARAAYVVADVTRSEDAVRAVEFTVERFGRLDAAFNKRRHGAGRTPLHLMDDPVYDDIMDTNVRGVFNCLRPEIAAMLASGAGGSIVNTSSTGGLVATPVAAPYVVSKHAVLGLTKGPAAEYGAHGIRVNAIAPGTTRSEMVADWFAQNPDAEELLHRATPQPRTAEPQEIAEAAAWLCSERASFVTGSTLVVDGGFTIL

SEQ ID NO: 26902 - protein, 1431 aa, Parartemia zietziana
MKSYPFILLALSAFASSYEVRGILCNDKATIKRTWSIVTDLPSFGRNVFLTVFAYKPEYKDLFVEFRNIPASELANSDRLLYHGSRVLTSVNEVISSIDSPDQVVKKLVALGERHITRGTVRRHFEAFSYAFIDELKKMGVEPADLAAWRRGWDSIVDILEAGLLKRQIDVEVTGLSCVDVANVQESWFAVSANLKNTGSILFQRLINGHPEYQTLFRQFREVELANLGESNGFVAHVFRVIAAFDGIIRELDNNAFTVSTLKRLGEQHIARGTDITHFQNFRIVLLAYLAENGLTEAQGVSWNKAFDAIEKYISMGLKSLERVDPITGLSGLEKKAILNAWGKVRGNIQGVGKATFAKLFTAHPEYQQMFRFFRDVELTELVESPKFAAHTQRVVSALDQTLLALDKPSDFVYMIKELGLDHINRGTDRSHFENYQVVFIEYLKETLGDSVDEFTVKSSNHVFEVIINFLNEGLRQANIVDPVTHLSGRQKEMIKNSWSIARTDLRFLGQELFMRMFKVNPEYQSLFVNKGFADVSMTELRGDERFISHMANVLRGFDTLLQNLDDTSYFVYALRNLGDAHIQRKTGTGHFRNFEAILIPYLQESQGLNAAGVEAWKKFFDVAIGVIAQGLKVVTPEEADPVTGLYGKEIDALRQAFAAIAPRNVEIGKRVFAKLFAAHPEYKNLFKKFEQHSVEVLPSTDDFDHHISLVMNRFTSIGKAIDDNASFVYLLKKLGREHIKRGLSRKQFDLFVELYIAEISPELSETARSGLRKVLDFANGVIEQGLFQLGQVDSKALTALEKQSILDIWTNLRSVGLEELAVKMFTKLFEAHPEYKLLFTNRFGNVDNIAENAPFRAHLHRVLSAFDIVIYNLDNNALLIRQLRDLGVFHTRLGMTRAHFDNFATAFFSVAEAIVPNQLTVLGRESMNKGFKLMISVIEEGLLQLERVDPITGLSEREVAVVKQTWNLVKPDLMGVGMRIFRSLFETFPAYRVVFPKFGDVPLNQLADIPAVGKHAIAVTAKLDQLIQTLDEPANLALLARQLGEDHIVLQVNRPMFKNFGTVLVRLLENDLGQKFSNYASKAWHKAYNVITEYIEEGLQQSYKQDPVTGITDAEKQLVQESWELLKPDLMGLGQKVFGRIFTKNPEYQTLFTRVGFGDTPLTQLMANPAYGAHLIKVMRSFDFVIQNLGKPKTLLAYLKNVGADHIARNVERRHLQAFSESLIPVMQNELKAKLKPEAVAAWRKGLDRIIGVIDQGLLGLKEVNPQIAFSAADIQAIQQTWALAKPDLMGKGATVFRNLFNEHSEYQPLFSNLVGYEVTALEGSPELNAHARNVMAQLDVFVRSLENSIELGRSLNQLGKDHVPRKVNKIHFKEFAEDFVVLMKADLGEEFTPLAESAWKKVFDVMISTIEQGQRARRSIATFLTNPVA

SEQ ID NO: 26903 - protein, 325 aa, Eumesocampa frigilis
  unsure (1)..(325): unsure at all Xaa locations
DVTTDNGVFRAAVPSGASTGIYEAHELRDDDKAVHHGKGVLKAIANVNNIXGPELIKSAIEVTDQKGIDEXMVKLDGTENKSKLGANAILGXSMAVAKAGAAXKXIPLYRYLAELAENKNXLLPVPAFNVINGGSHAGNKLAMQEFMILPTGAATFKEAVRMGSEIYHHLKKVIHKKFGLDATAVGDEGGFAPNIQNNKEGLTLVQEAIQVAGYAGKVDIGMDVAASEFCKDGKYDLDFKNPDTKPEDWITADQLLDLYQDFVKDFPNIVSIEDPFDQDDWEAWTKMTADGSMNAIQIVADDLTVSNTKRIETAIEKKACNCLLL

SEQ ID NO: 26904 - protein, 159 aa, Eumesocampa frigilis
ASEFHKSGKYDLDFKNPKSNEADWIDGDQLLAIYEGFVKEFPVVSIEDPFDQDHWDAWTKMTAALPIQIVGDDLTVTNPKRIKTAVEKKACNCLLLKVNQIGSVTESIEAHNLAKSHGWGTMVSHRSGETEDTFIADLVVGLSTGQIKTGAPCRSERLA

SEQ ID NO: 26905 - protein, 321 aa, Limulus polyphemus
  unsure (1)..(321): unsure at all Xaa locations
DLTTDKGMFRAAVPSGASTGIYEALELRDGDKTKYHGKSVGKAVDNVNSIIAPALWPKNFEATQQGEIDEFMLSLDGTENKAKLGANSILGVSLAVCKAGAAQKXVPLYRHIADLAGYGDVILPVPAFNVINGGSHAGNKLAMQEFMILPTGASSFTEAMKMGSEVYHHLKNVIKKRFGLQATAVGDEGGFAPDIQSNKEALELIKEAIQIAGYVGKIEIGMDVAASEFHKEGKYDLDFKNPNSDSSQWLTPDALAAMYQEFIRDYPIVTIEDPFDQDHWDAWTSFQAAVQIQVVGDDLTVTNPKRIQMAVEKKSCNCAPV

SEQ ID NO: 26906 - protein, 159 aa, Peripatus sp. 'Per3'
  unsure (1)..(159): unsure at all Xaa locations
ASEFHKDGKYDLDFKNPKSDPSQWIDSDKLAALYQEFITEYPVVSIEDAFDQDHWDAWAKFQASTKIQLVGDDLTVTNPKRIKTAVEKKACNCLLLKVNQIGSVSESIEACXLAKSNGWGVMVSHRSGETEDSFIADLVVGLCTGQIKTGAPCRSERLA

SEQ ID NO: 26907 - protein, 385 aa, Polyxenus fasciculatus
  unsure (1)..(385): unsure at all Xaa locations
DLTTERGIFRGAVPSGASTGIYEALELRDNDKSVHHGKGVLKAIANVNDIIAPALIDLGKNLEITDQEGIDMFLLDLDATENKGKLGANAILGVSLAVCKAGAAHRGLPLYRYIAELAGNSKIILPTPAFNVINGGSHAGNKLAMQEFMILPTGASSFTEAMRMGSEVYHHLKSVIKSRFGLDATSVGDEGGFAPNILNNKDALELIKTAIEKAGYTGKIEIGMDVAASEFFKDGLYDLDFKNPSSNKKDYLKPDKLADLYREFVKDYPVTSIEDPFDQDDWDAWTNLTASVPIQIVGDDLTVTNPKRIATAVEKKACNCLLLKVNQIGTITEAINAHLLAKSNGWGTMVSHRSGETEDSFIADLVVGLSTGQIKTGAPXRSERL

SEQ ID NO: 26908 - protein, 384 aa, Scolopendra polymorpha
DLVTEKGLFRAAVPSGASTGVHEALELRDDDKKVHHGKGVLKAVCHINNEIAPALIAKNFDITNQKEIDDYMICCDGTENKSNFGANAILGVSLAVCKAGAAHKGIPLYKYIAELAGNEKIVLPVPAFNVINGGSHAGNKLAMQEFMILPTGASSFSEAMRMGSEVYHHLKKVIKDKFGLDATSVGDEGGFAPNIQDNKEALELIKTAIEKAGYTGKIEIGMDVAASEFFKEGKYDLDFKNPQSDSSKWITPSALADIYRDFCKNYPMVSIEDPFDQDDWDAWTQLLSTVDIQIVGDDLTVTNPKRIQTAVDKKACNCLLLKVNQIGSVTESIQAHLLAKKNGWGTMVSHRSGETEDSFIADLVVGLSTGQIKTGAPCRSERLA

SEQ ID NO: 26909 - protein, 383 aa, Tomocerus sp. jcrjws1
DLTTDKGLFRAAVPSGASTGIYEALELRDNDKANYHGKGVTKAVDNINKIITPALLGQNLDVTKQKDIDDFMLKLDGTENKDKLGANAILGVSMAVCRAGAAEKGIPLYKYIAELAGNPNVILPVPAFNVINGGSHAGNKLAMQEFMIFPTGASSFTEAMKMGSEVYHHLKNVIKAKFGLDATSVGDEGGFAPNILNNNDALLLITEAIQKAGYTGKIEIGMDVAASEFHRDGKYDLDFKNPQSDKAAWLTGDQLGDLYQEFIKGYPMVSIEDPFDQDHWDAWTKLTANTTIQIVGDDLTVTNPKRINTAVEKKACNCLLLKVNQIGSVTEAINANLLARKNGWGTMVSHRSGETEDTFIADLVVGLCTGQIKTGAPCRSERL

SEQ ID NO: 26910 - protein, 219 aa, Speleonectes tulumensis
DLVTDKGLFRAAVPSGASTGIYEALELRDNIKGDYHGKGVGKAIGHVNTDIAPKLLAQNFEPTQQVQIDEFMLKEDGTDNKSKFGANAILGVSLAVCKAGAAAKGVPLYRHIADLAGVGDVILPVPAFNVINGGSHAGNKLAMQEFMILPTGASSFSEAMKMGSETYHHLKKVIKDRFGLDATAVGDEGGFAPNILNNKDALNLISDAIAKAGYTGKIE

SEQ ID NO: 26911 - protein, 192 aa, Speleonectes tulumensis
  unsure (1)..(192): unsure at all Xaa locations
GTHAGNKLAMQEFMLLPVGAKSFREAMQIGTEVYHNLKGVIKKXYGMDATXVGDEGGFAPNILSNYEALDLLVXAIKNAGHEGKVKIGMDVAASEFWKADKKVYDLDFXTENXDXSXKRTGEALADMYKEFCDKYPMVSIEDPFDQDDWKSYAALTVTIGDKVQIVGDDLLVTNPKRVQKALDEKACNALTM

SEQ ID NO: 26912 - protein, 162 aa, Speleonectes tulumensis
  unsure (1)..(162): unsure at all Xaa locations
ASEFWKADEQAYDLDFKTDSNDGSLRTTGEELMNMYIEFCEKYPMVSIEDPFDQDDWTSYAALTSKMGETTQIVGDDLLVTNTXRVQRALDEAACNGLLLKVNQIGTVTEAVEACKMAQLHNWGVMVSHRSGETEDTFIADLVVGLRAGQIKTGAPCRSERL

SEQ ID NO: 26913 - protein, 171 aa, Dirofilaria immitis
MADIAAKFAENEITPNIITNPPAKLLNCNWDGIQVQPGQMMSPRNLRFAPRVTLDVDPESTFSMIMIDPDNLSRKNPSVAEWLHWLVVNIPASNIQEGINGGQHQMAYGSPAPQPRTDIHRYIILLYEHQGRRIQVPKINSRAKFNIKQFVEKHKLGDPIAGNFFLAQNEG

SEQ ID NO: 26914 - protein, 512 aa, Danio rerio
MEYHSVGPGGVVVTGNNVPAFLTKLWTLVEDPDTDPLICWSPNGTSFHVFDQGRFSKEVLPKYFKHNNMASFVRQLNMYGFRKVVHIEQGGLVKPEKDDTEFQHPYFIRGQEQLLENIKRKVTTVSNIKHEDYKFSTDDVSKMISDVQHMKGKQESMDSKISTLKHENEMLWREVATLRQKHSQQQKVVNKLIQFLITLARSNRVLGVKRKMPLMLNDSSSAHSMPKFSRQYSLESPAPSSTAFTGTGVFSSESPVKTGPIISDITELAQSSPVATDEWIEDRTSPLVHIKEEPSSPAHSPEVEEVCPVEVEVGAGSDLPVDTPLSPTTFINSILQESEPVFRPDSAPSEQKCLSVACLDKTELHDHLESIDSGLENLQQILNAQSINFDSSPLFDIFSSAASDVDLDSLASIQDLLSPDPVKETESGVDTDSGKQLVQYTSQPSFSPIPFSTDSSSTDLPMLLELQDDSYFSSEPTEDPTIALLNFQPVPEDPSRTRIGDPCFKLKKESKR

SEQ ID NO: 26915 - protein, 340 aa, Zaocys dhumnades
MSDQSPFETDMITLNRYVMEKGRRVKGATGELTQLLNSTLTAIKAISSAVRKAGLAHMYGIAGSVNVTGDEQKKLDVLSNSLVINMLQSSYSTCVLVSEENKEALITPKEKRGKYVVCFDPLDGSSNIDCLASIGTIFAIYKKTTEDEPSEKDALQPGRNIVAAGYALYGSATLVALSTGQGVDSFMLDPGLGEFILVEKDVKIKKKGKIYSLNEGYAKYFDPAVTEYLHKKKFPEEGKSPYGARYVGSMVADVHRTLVYGGIFLYPANQKSPKGKLRLLYECNPIAFIIEQASGIATTGTEPVLDVKPESIHQRVPFVAGSPEDVQEYLAFVQKHQKSS

SEQ ID NO: 26916 - protein, 898 aa, Gallus gallus
MRKGVPKDPEIADLFYKDDPEEIFVGLHEIGHGSFGAVYFATNSHTNEVVAVKKMSYSGKQTNEKWQDIIKEVKFLQQLKHPNTIEYKGCYLKEHTAWLVMEYCLGSASDLLEVHKKPLQEVEIAAITHGALQGLAYLHSHCKIHRDIKAGNILLTEPGQVKLADFGSASIVSPANSFVGTPYWMAPEVILAMDEGQYDGKVDVWSLGITCIELAQRPPPLFNMNAMSALYHIAQNDSPTLQSNEWSDSFRGFVDYCLQKIPQERPSSADLLRHDFVRRDRPPRVLIDLIQRTKDAVRELDNLQYRKMKKILFQETRNGPLTESQEEEEDSEHGSNLSRKMDSLGSNHSIPSMSVSTGSQSSSVSSMQEVLDESSPELVMMHSDESAVNSTSSVVQKKDHVFIRDEVGHRDRRPEVRPTQSVQNQALHYRNRERFATIKSASLVTRQIHEHEQENELREQMSGYKRMRRQHQKQLIALENKLKAEMDEHRLKLQKEVETHANNSSIELEKLAKKQVAVMEKEAKTAAADEKKFQQQILAQQKKDLATFLESQKKQYKLCKEKIKEEMNEDHSTPKKEKQERISKHKENLQHTQAEEEAHLLSQQRLYYDKNCRFFKRKTMIKRHELEQQNIREELNKKRTQKEMEHAMLIRHDESTRELEYRQLHTLQKLRMDLIRLQHQTELENQLEYNKRRERELHRKHFMELRQQPKNLKAMEMQIKKQFQDTCKVQTKQYKALKNHQVEVTPKSEHKTILKSLKDEQTRKLAILAEQYEQSINEMMASQALRLDEAQEAECQALRLQLQQEMELLNGYQSKIKMQTEAQHERELQKLEQRVSLRRAHLEQKIEEELAALQKERSERIKFLLERQEREIETFDMESLRMGFGNLVTLDYPKEDYR

SEQ ID NO: 26917 - protein, 464 aa, Volvox carteri
AVSYSVSVYNNIAVTGAPLSGIVSQLLSKWKLNVPTLRTVYSQPSAAELSSTNAFIVYSKGQGSYWITEGLTSNSTKVNDLLTFVRNGGSLILVNGANGNDNTFIPLIHALTGGDTLCIARSYADDTRIYRRIDPPSNFGNLPVKQFRYTADLYITGLDCLSGTSIYSSDPTKKLYAISAGITWSVGQGAVTWVGADIVADSKNTVALVTAAAVVVQTTPSPPPPPRVSTSPPPPARVSSSPPPATRSPPPRRITSPSPVLTASPPLPKTSPPPPPRVPPSPPPPVASPPPPPPPRVSPSPPPPQPVSSPPPPPPPRPSPSPPPPRSSPSPPPPSPPPPSPPPPRPSPSPPPPRSSPSPPPPVVSPPPPPPRASPPPPPASSPPPPPRPPPPSPPPSPPPPATAAANPPSPAPSRSRAGGPPLGTRPPPPPPEDDAPPPDYYFPPPQDMSPPPPKKKATGRRLL

SEQ ID NO: 26918 - protein, 288 aa, Sinorhizobium meliloti
MKTLTADRRMIKIAMEAPYLERDEEHALAQAWRNDNDQEARNKIAMSHMRLVISMAAKFRSFGLPMGDLVQEGHIGLLEAAARFEPSREVRFSTYATWWIRASMQDYVLRNWSIVRGGTSSAQKALFFNLRRLRARLAQGDRQLTSQAMHEEIAAALGVSLADVQTMDARLSGNDASLQAPIGSGDPDAGARLDFLASEAPLPDEQVSDLIDGERARRWLQVALGELSEREMKIIRARRLTEDGATLEELGVALGISKERVRQIETRALEKLRAALTAKAPALTASMH

SEQ ID NO: 26919 - protein, 429 aa, Trypanosoma brucei brucei
MTIQKVHGREVLDSRGNPTVEVEVTTERGVFRSAVPSGASTGVYEACELRDGDKKRYVGKGCLQAVKNVNEVIGPALIGRDELKQEELDTLMLRLDGTPNKGKLGANAILGCSMAISKAAAAAKGVPLYRYLASLAGTKELRLPVPCFNVINGGKHAGNALPFQEFMIAPVKATSFSEALRMGSEVYHSLRGIIKKKYGQDAVNVGDEGGFAPPIKDINEPLPILMEAIEEAGHRGKFAICMDCAASETYDEKKQQYNLTFKSPEPTWVTAEQLRETYCKWAHDYPIVSIEDPYDQDDFAGFAGITEALKGKTQIVGDDLTVTNTERIKMAIEKKACNSLLLKINQIGTISEAIASSKLCMENGWSVMVSHRSGETEDTYIADLVVALGSGQIKTGAPCRGERTAKLNQLLRIEEELGAHAKFGFPGWS

SEQ ID NO: 26920 - protein, 371 aa, Pisum sativum
MAGVNQNGVAEFPAVQTHGGQFVQYNVFGNLFEVTAKYRPPIMPIGRGAYGIVCSLLNTETNELVAVKKIANAFDNHMDAKRTLREIKLLRHLDHENVIGLRDVIPPPLRREFNDVYITTELMDTDLHQIIRSNQNLSDEHCQYFLYQILRGLRYIHSANIIHRDLKPSNLLLNANCDLKIIDFGLARPTMENDFMTEYVVTRWYRAPELLLNSSDYTSAIDVWSVGCIFMELMNKKPLFPGKDHVHQMRLLTELLGTPTDADVGLVKNEDARRYIRQLPQYPRQPLNRVFPHVHPLAIDLIDKMLTIDPTRRITVEEALAHPYLEKLHDVADEPICMEPFSFEFEQQHLDEEQIKEMIYREALALNPEYA

SEQ ID NO: 26921 - protein, 377 aa, Branchiostoma floridae
MADTAGKPISCRAAVAWEAKKPLVIETIEVAPPKAHEVRIKVLATGVCHTDAYTLSGADSEGKFPVVLGHEGGGVVESVGEGVTGFQPGDHVIPLYIPQCRDCKFCRSPKTNLCQKIRVSQGQGVMPDGSSRFTCKGQTVYHFMGTSTFSEYTVVADISLCKVAESAPLEKVCLLGCGISTGYGAALNTAKVEPGSTVAVWGLGAVGLAVIMGAKVAGASRIIGVDINPDKAEIAQKFGMTEFVNPKDHDRPIQQVLADMTDGGLDYTFECIGNVHTMRAALEACHKGWGTSVIIGVAAAGQEISTRPFQLVTGRVWKGTAFGGWKSVESVPRLVGEYQAGKIKVDEFISHTFPLDNINESFRLMHDGESIRSVIHF

SEQ ID NO: 26922 - protein, 377 aa, Branchiostoma lanceolatum
MAETAGKPITCRAAVAWEAKKPLVIETIEVAPPRAHEVRIKVLATGVCHTDAYTLDGFDSEGKFPVVLGHEGGGVVESVGEGVSGFKPGDHVIPLYVPQCKECKFCKSPKTNLCQKIRVTQGQGVMPDGSTRFTCKGQTVFHFMGTSTFSEYTVVADISLCKVTESAPLDKVCLLGCGISTGYGAALNTAKVESGSTVAVWGLGAVGLAVIMGAKVAGASRIIGVDINPDKAEIAKKFGMTEFVNPKDHDKPIQQVLVELTDGGLDFTFECIGNVHTMRAALESCHKGWGTSVIIGVAAAGQEISTRPFQLVTGRVWKGTAFGGWKSVDSVPKLVEEYQSGKIQVDEFISHNFPLDKINDSFHLMHAGESIRSVVHF

SEQ ID NO: 26923 - protein, 372 aa, Pisum sativum
MATPVEPPNGIRADGKHYYSMWQTLFEIDTKYVPIKPIGRGAYGIVCSSVNRETNEKVAIKKIQNAFENRVDALRTLRELKLLRHLHHENVIALKDIMMPVHRTSFKDVYLVYELMDTDLHQIIKSSQTLSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKRYIKSLPYSPGTPFSRLYPNAHPLAIDLLAKMLVFDPTKRISVTEALQHPFMASLYDPNCDPPAIIPIDLDIDEDLGEEMIRELMWREMVHYHPGSAMGNAELSS

SEQ ID NO: 26924 - protein, 267 aa, Streptomyces galilaeus
MNRAARPTVRGMSAIAEPTAPRGVIVTGGGTGIGRATAHAFADRGDRVLVVGRTAATLAGTAEGHPGISVLTADLTDPDGPRAITDAALDALGRIDVLVNNAATGGFAGLAETEPEAAREQFDSNLLAPLLLTRQTLDALSADGGGTVLNIGSAGALGRRAWPQNGVYGAAKAGLDFLTRTWAVELAPRGIRVLGLAPGVIDTGIGERSGMSREAYAGFLGQIAARVPAGRVGRPEDIAWWAVQLADPRAAYATGAVLAVDGGLSLT

SEQ ID NO: 26925 - protein, 310 aa, Brassica rapa subsp. pekinensis
MMKRLSSSDSVGGLISLCPTTSTDQPSPRRYGREFQSMLEGYEEEEEEAVTEERGQTGLAEKKRRLSINQVKALEKNFELENKLEPERKVKLALELGLQPRQVAVWFQNRRARWKTKQLEKDYGVLKTQYDSLRHNFDSLRRDNESLLQEIGKLKAKLNGEEEVEKMMKMENNAVTMECDVSVKEEEVSLPEELTDPPSSPPQALEHSDSFNYRSFTDLRDLLSLKAAASSVAAAGSSDSSDSRAVLNEESSSNVTAGPVTVPQGGFLQFVKMEQTEDHDDFLSGEEACGFFSEEQPPSLHWYSTVDQWN

SEQ ID NO: 26926 - protein, 376 aa, Treponema pallidum
MSVRRVVVLGITGSIGAAALKLLRRFPDRFLLVGASGHRQTEYARALAREFSLSDITMTGSCSEQEGRARIKRLLSSCEAEVVVNGIAGAAGLFASLEVLKTRCTLALANKESVVLAASLLHAAARESGATIVPVDSEHAAIFQLIAAHGAHAVAQVVLTASGGPFRTFSKECLAHVTVEDALQHPTWRMGKKISVDSATLANKALEVIEAVQFFRIPVDRVTVVVHPQSIVHALVQCHSGETYAQLSVPDMASPLLYALLYPDAPPAYQTPLDFTSGLSLHFEPPRVDDFPLLRMGFDVARAQRAYPIAFNAANEEAVRAFLQRNIGFLDIAHVTAQALQEDWRAIPQTFEEVMACDTRARMCARTCIAQRWRER

SEQ ID NO: 26927 - protein, 475 aa, Mentha x piperita
MALNLMAPTEIKTLSFLDSSKSNYNLNPLKFQGGFAFKRKDSRCTAAKRVHCSAQSQSPPPAWPGRAFPEPGRMTWEGPKPISVIGSTGSIGTQTLDIVAENPDKFRIVALAAGSNVTLLADQKAFKPKLVSVKDESLISELKEALAGFEDMPEIIPGEQGMIEVARHPDAVTVVTGIVGCAGLKPTVAAIEAGKDIALANKETLIAGGPFVLPLAKKHNVKILPADSEHSAIFQCIQGLPEGALRRIILTASGGAFRDLPVEKLKEVKVADALKHSNWNMGKKNTVRLLQLFFNKGLEVIKAHYLFGAEYDDIEIVIHSPSIIHSMVETQDSSVLAQLGWPDMRLPILYTLSWPERVYCSEITWPRLDLCKVDLPFKKPDNREIPAMDLAYAAWKSRSTMTGVLSAANEKAVEMFIDEKIGYLDIFKVVELTCDKHRSEMAVSPSLEEIVHYDQWARDYAATVLKSAGLSPALV

SEQ ID NO: 26928 - protein, 161 aa, Parasponia rigida
SSSEVNKVFTEEQEALVVKAWAVMKKNSAELGLQFFLKIFEIAPSAKNLFSYLKDSPVPLEQNPKLKPHATTVFVMTCESAVQLRKAGKVTVKESDLKRIGAIHFKTGVVNEHFEVTRFALLETIKEAVPEMWSPEMKNAWGVAYDQLVAAIKFEMKPSST

SEQ ID NO: 26929 - protein, 161 aa, Parasponia rigida
SSSEVNKVFTEEQEALVVKAWAVMKKNSADLGLQFFLKIFEIAPSAKNLFSYLKDSPVPLEQNPKLKPHATTVFVMTCESAVQLQKAGKVTVKESDLKRIGAIHFKTGVVNEHFEVTRFALLETIKEAVPEMWSPEMKNAWGVAYDQLVVAIKFEMKPSST

SEQ ID NO: 26930 - protein, 162 aa, Trema tomentosa
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFEVTRFALLETIKEAVPEMWSPEMKNAWGEAYDQLVAAIKSEMKPSST

SEQ ID NO: 26931 - protein, 338 aa, Gossypium hirsutum
MASSWFFIVFLVLTVASVRCTTVDHMPSTDEDARDYSKLKTKTEEATDEHHSRTQQAKDELKSKADHAANEVKSNTQQAKDRASEVGKEAKEYTESWTEWAKEKISEGLGFKQDDDPKGSVEKAFDSVADTATKTKDKLQDMASGAGEYSAGKAKDMKDTAYKKTDDVKNAAKGKSSEMRQATTEKARELADSAKENANTAYIAAKEKVRDMADRTSEMTNEAQERAARKAEEAKEVAAEKAKDAAEETKKKNEETGESLKWAKEKAKQGYDATTEKAKETARQGYDAAKSKAGETVESAKDTIASGYESAKQKSQELKDNYVNGGGQGRGRERDEEL

SEQ ID NO: 26932 - protein, 248 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGWEGGEQNVTYAHHQAQSQGLYQPLECNPTLQMGYDNPVCSEQITATTQAQAQPGNGYIPGWML

SEQ ID NO: 26933 - protein, 324 aa, Arabidopsis thaliana
HPPPPYMWNPQHMMSPYGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKLHQLLDTKPRAKAVAAG

SEQ ID NO: 26934 - protein, 200 aa, Asarum europaeum
GGIFKKAQELTVLCDAQVSLIMFSSTGKYSEYCSPSTTTKQIYDKYQEASGINLWSSHYEKMQNLLNKLNDDNNKLRKEIRQRIGEDLSGLEIEELRGLEQNLESSLKVVRDKKYQVISSQTETKKKKVKNLEQTHKNLGCALAGKDAICAYGIAYNETLDYKSVLGLANDASHIFAFRIQPCQPNLHNAGYGIHDLRLA

SEQ ID NO: 26935 - protein, 189 aa, Calycanthus floridus
GGILKKAREITVLCDAEVSLIMFSSTGKFSEYCSPPTTTKKIFDRYQHVSGINLWNSHYEKMQNHLSKLTEDNNRLRREIRQRMGEDLNELEIDELRGLEQNLNDSLKVVRERKYHVINTQTETYKKKLRSLHEIHTNLIHTLEGREVNGHFGFSGNDAPHYGAVINLAHGGNHDLHEIAYGSNDLRLA

SEQ ID NO: 26936 - protein, 202 aa, Calycanthus floridus
GGILKKARELTVLCDAEVSLIMFSSTGKFSEYCSPSSTAKKIFDRYQQVSGINLWNSHYEKMQNHLNKLKEDNNNLRREIRQRMGEDLNDLEIDELRGLEQNLDNSLKVVRERKYHVINTQTETYKKKLRSLHEAHANLLRALEEGNDDNGDYGMGNNGGADYQAAAFGWANEGSQMFALCVQPCHPNLQDARSGHHDLRLA

SEQ ID NO: 26937 - protein, 194 aa, Chloranthus spicatus
GGILKKAKELSVLCDAQVSLIMSSSTGKFYEYCSPGTNTKKIFDRYQQASGINLWNSQYEKMQEYFEKLKETNNKLRKEIRQRRGEDLNGLNINELRSLEQNLDDSLKIIRERKYHVIKTQTETYGKKLKHRQEEHEKLLHRLEGIDMNQGYDMLDREGDYETAFGLANGGGHVFAFRLQPIQPNLHDNGYGTH

SEQ ID NO: 26938 - protein, 202 aa, Hydrangea macrophylla
NGLFKKANELTVLCDAKVSIIMFSTTNKLHEYISPSISTKELFDLYQTTMGIDLWSSHYERMQENLKKLKDVNRNLRMEIRQRMGESLNDLSWKDLRGLEQEMDSSVKIIRERKYRVLGNQIDTHRKKVRNAEEIHRYIIHEFEVKEEDPHYGLVDNGGNYDSVLGFPNDGPPRIVAFRLQTNQHSLCTGGGSDLTTYALLD

SEQ ID NO: 26939 - protein, 201 aa, Hydrangea macrophylla
NGIIKKAQELTVLCDAKVSLIMISTTGKFHEYTSPSTTTKQIYDQYQKTLDIDLWSTHYERMQEHLRKLKEVNNKLRREIRQRLGEDLNDLNLNELRDLEQKSAASTAVIRERKYHVLKTQTETCRKKVRNLEERYGNLFLDWEGKCEDPQYGLVENDGEYDSAVAFANRVPNSYAFGLQPSHPNLHHGGGGYGSHDLRLA

SEQ ID NO: 26940 - protein, 225 aa, Petunia x hybrida
MGRGKIEIKKIENSTNRQVTYSKRRNGLFKKAKELTVLCDAKICLIMLSSTRKFHEYTSPNTTTKKMIDLYQRTLGVDIWNKHYEKMQENLNRLKDINNKLRREIRQRTGEDMSGLNLQELCHLQGNVSDSLAEIRERKYHVIKTQTDTCRKRVRNLEEQHGSLVHDLEAKSEDPTYGVVENEGHFNSAMAFANGVHNLYAFRLQTLHPNLQNGGGFGSRDLRLA

SEQ ID NO: 26941 - protein, 230 aa, Sagittaria montevidensis
MGRGKIEIKKIENSTNRQVTYSKRRAGLIKKAEELTVLCDAQINLILISGSRKVHHYCSPSTDIHTVMDRYQQLTDSDLWQPQYEGMQKTLNHLKETNNNLRKQIRQRMGEDLEDLNMNELLALEREMDESITVVRDKKYHVLTTRTDTAKKKWKNGQQRYNSLVQDLVKLEGVEILDYACASIEASDYKPPIAMSIASRPADVGYAFHHSAGQSNVHDVGYGFHELRLA

SEQ ID NO: 26942 - protein, 200 aa, Tacca chantieri
QGIMKKAKELTVLCDAEVSIIMFSSTGKFAEYCSPSTDTKKVYDRYQQVTGIDLWSSQYERMQNNLNHLEEINRNLRREIRQRTGEDLDGLDIKELRGLEQNVDEALRIVRQRKYHVITTQTDTYKKKLKNSHEAHRNLMRELEMRDEHPVYGFVDNDPTNYDSALALANAGSHVYAYRVQPSQPNLHGIGYSSHDLRLA

SEQ ID NO: 26943 - protein, 184 aa, Asarum europaeum
GGILKKAREISILCGAQVSLIIVSSTGKVYDFCSASTPLADILDKYHSSSENKLWDPKHEYLSNEVKRIKKENDSMQIKLGHLKGEDVNSLHLNELIPIEEALQDGLDGVRAKQAELLKTLKKNGRALEDENKRLAYILHHQQIAMDENKREMDNGYHKREEYPSQMPFAFCVQPMQPNLHQKK

SEQ ID NO: 26944 - protein, 186 aa, Calycanthus floridus
GGILKKAKEITVLCDAQVSLVIFSSTGKMSEYCSPSTTLVKILDRYQKASGKRLWDAKHEYLNNEVERIKKENDSMQIKLRHLKGEDLTSLHPKELIPIEEALENGLASVRDRQMECLRIYKKNERTLEDENKRLTYILHQQQQMAMDGNVREVDHGYHHKIRDYSNQMPFAFRIQPIQPNLHQDK

SEQ ID NO: 26945 - protein, 184 aa, Calycanthus floridus
SGLLKKAKEITVLCDADVSLIIFSATGKMSEYCSPSTSLIKILDRYQKASGNKLWDAKHEYLSMEVERIKKENDSMQIELRHLKGEDLTSLRPKELIPIEEALQNGLTNVRERQEELLKILKKNEKVLEEENMRLSYILHHQQLAMDGSMREMEQGYHHEESDYPSDMQLAFRVQPLQPNLQNK

SEQ ID NO: 26946 - protein, 200 aa, Chloranthus spicatus
IENSTNRQVTFSKRRNGIVKKAKEITVLCDAKVSFIIFSTTGKMFEFVSPSTTLMDMLERYQTNSGKRLWDAKHERLSAELDRIKKENDSMQIELRHLKGEDINSLHPKELIPIEEALQSGLTNVRAKQMDFLKMLKKNERTLEDENKRLSYILHHQQLALDGNMRDLDNGFHPKERDYSSQMPFIFRVQPIQPNLQQSK

SEQ ID NO: 26947 - protein, 187 aa, Hydrangea macrophylla
NGILKKAKEITVLCDASVSLIVFASSGKMHEYCSPKTTLIDILDKYHTQSGKRLWDAKHENLSNEIDRIKKENDNMQIELRHLKGEDVTSLNHKELMALELALENGLASIRDRKDEVFEMIKKNVKIQALEDDNKRLIYELHQQEMNMECNVREMENGYQRVGDYQSHQMPFAFRVQPIQPNLQERM

SEQ ID NO: 26948 - protein, 208 aa, Sagittaria montevidensis
MGRGKIEIKRIENSANRQVTYSKRRNGIIKKAREISVLCGCEVSLVIFSSSGKMSEFHSTTLSKILETFQQNQGQTLWGAKHESLKAEIDRMKKENDNMRIQLRHMKGEDLTSMEPRDLYTIETALINGIANVRGKQMEIFKKKAKNQKALEEENKQLAYILHQQSLAMNGNLREMPQDYHQKDRDFTAPVPFGFRVQPMQPNLQENK

SEQ ID NO: 26949 - protein, 186 aa, Tacca chantieri
NGIIKKAREISVLCDAQVSVVIFSSSGKMSEYCSPSTSLSKMLEKYQQNSGKKLWDAKHENLSAEIDRMKKENDNMQIELRHLKGEDLNQLNAKELIPIEDALHNGLTNVREKQMDFLKMLKKNERLLEEENKRLTYILHHQQLAMNGNVREMDLAYHQKDREYPPQMPLAFRVQPLQPNLQEDKQ

SEQ ID NO: 26950 - protein, 437 aa, Brassica oleracea var. acephala
MKGVRKTYDSSCTLSFLLVFFVMIIFHPVFSINTLSATESLTISSNRTLVSPGNVFELGFFRTTSSSRWYLGIWYKKLSNRTYVWVANRDHPLSNSTGTLKITSNNLVILGHSNKSIWSTNRTKGNERSPVVAELLANGNFVMRDSNNNRSSRFLWQSFDYPTDTLLPEMKLGYDLKTGLNRFLTSWRSSDDPSSGDFSYKLRARRLPELYLSSGIFRVHRIGPWNGIRFSGIPDDRKLSYLVYNFTENNEEVAYTFRMTNNTIYSRLTVSFSGYIERQTWNPSLGMWNVFWSFPLDSQCDAYRACGPYSYCDVNTSPICNCIQGFNPSNVEQWDQRVWANGCIRRTRLSCSGDRFTMMKNMKLPETTMAIVDRSIGVKECEKRCLSDCNCTAFANADIRNGGAGCVIWTGRLDDMRNYAADHGQDLYVRLAAANLV

SEQ ID NO: 26951 - protein, 444 aa, Brassica oleracea var. acephala
MRGVIPNYHHSYTLLFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPVDTLLPEMKLGRNRNGSGNEKILTSWKSPTDPSSGDYSFILETEGFLHEFYLLNNEFKVYRTGPWNGVRFNGIPKMQNWSYIDNSFIDNNKEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYNAGGQDLYVKVAAASLVPS

SEQ ID NO: 26952 - protein, 113 aa, Lactococcus lactis subsp. cremoris
MKKIEAIIRTDKLEDLKKALSDNGLVHGMTVSQVLGYGEQKGFAEYVRGQRIETTLLSKIKIEIVSIDEKVDQIVNVITKAVRTGEVGDGKIFIQPVERVIRIRTSEEDAQAL

SEQ ID NO: 26953 - protein, 147 aa, Medicago sativa
MSFTDKQEALVNSSWEAFKQNLPRYSVFFYTVILEKAPAAKGLFSFLKNSAEVQDSPQLQAHAEKVFGLVRDSAVQLRATGGVVLGDATLGAIHVRKGVVDPHFVVVKEALLKTIKEAAGDKWSEELNTAWEVAYDALATAIKKAMS

SEQ ID NO: 26954 - protein, 131 aa, Medicago sativa
KSFKQNPGNSVLFYTIILEKAPAAKGMFSFLKDSAGVQDSPKLQSHAEKVFGMVRDSAAQLRATGGVVLGDATLGAIHIQKGVVDPHFAVVKEALLKTIKEVSGDKWSEELNTAWEVAYDALATAIKKAMV

SEQ ID NO: 26955 - protein, 425 aa, Daucus carota
ACKSILKRKLVSKNDKEDIKREIQILQHLSGQPNIVEFKGVFEDRQSVHLVMELCAGGELFDRIIAQGHYSERAAATICRQIVNVVHVCHFMGVMHRDLKPENFLLSSKDKDAMLKATDFGLSVFIEEGKVYRNIVGSAYYVAPEVLRRSYGKEIDIWSAGVILYILLSGVPPFWAENEKGIFDAILEGVIDFESEPWPSVSNSAKDLVRKMLTQDPRRRITSAQVLDHPWMREGGEASDKPIDSAVLSRMKQFRAMNKLKQLALKVIAESLSEEEIKGLKSMFANMDTDKSGTITYEELKSGLARLGSKLSEVEVQQLMDAADVDGNGTIDYLEFITATMHRHKLESYEHQAFQYFDKDNSGFITKDELESAMKEYGMGDEATIKDIISEVDSDNDGRINYDEFCAMMRRARNRRKLFSVSLTS

SEQ ID NO: 26956 - protein, 82 aa, Lycopersicon esculentum
SGGGGYGGGRREGGGGGYGGGGGYGGGRREGGGGGYGGGGYGGGRREGGYGGGGGGYGGGDRYNVRSSRGGGGGGSDGNWRN

SEQ ID NO: 26957 - protein, 274 aa, Antirrhinum majus
MGRSPCCEKAHTNKGAWTKEEDQRLINYIRAHGEGCWRSLPKAAGLLRCGKSCRLRWINYLRPDLKRGNFTEEEDEIIIKLHSLLGNKWSLIAGALPGRTDNEIKNYWNTHIKRKLVSRGIDPQTHRSLNSATTTATATPTVNNSCLDFRTSPSNSKNICMPTTDNNNNSSSSTDDTKCNSSTTEESQSLITPPPKEEEKSVPLVDLELSLGLPSQSQCNKSVSLNSSSSGFYDLFRPPAKVAQRMCVCKWTLGLQKGEQFCNCQSFNGFYRYC

SEQ ID NO: 26958 - protein, 248 aa, Antirrhinum majus
MGRGKVQLKRIENKINRQVTFSKRRGGLLKKAHELSVLCDAEVALIVFSNKGKLFEYSTDSCMDRILEKYERYSFAERQLVSNEPQSPANWTLEYSKLKARIELLQRNHRHYMGEDLDSMSLKEIQSLEQQLDTALKNIRTRKNQLLYDSISELQHKEKAIQEQNTMLAKKIKEKEKEIAQQPQWEHHRHHTNASIMPPPPQYSMAPQFPCINVGNTYEGEGANEDRRNELDLTLDSLYSCHLGCFAA

SEQ ID NO: 26959 - protein, 719 aa, Emericella nidulans
MLLNGQISALSLDDNDNGQQHQDEVQAKHQDQGHTCPSRPSVPSLSRIYRCTPVPTIVLDASMVIIEVSNSHVALFGKPRDSLLHTSISDVSPECIPVPNIPILYGALRAACSTREIQVVEHVVVGEKIAHNLRVTPVYEDETLLFVVLEVENLRAEVINNQHAYMNETYKILVDTVKDYAIFMLDPTGHIATWNAGAGVLKGYKAEEIIGKHFSISIVPADRDNGKPARALDVCLREGRIEDEGWRYRRDGSRFWANVLITPIYQFGQHVGFVKVTRDLTERKEAEACMIAAFEESSRLKTDFLANISHEIRTPMNGIEIALTMLTDTGLSEEQGDANIVQDSMSLLLQIVNDVLDYSKLSIRLLSLHADMLDIREIVGAVVRNCRSSLQEGVELDTEISPKLHAHAWDPLRYRQVLQNLVGNAVKFTEKGSIHVKITSSTDEEDSDSSVVRTEVTDTGIGVPDSAINHSLHPLLAFANSAARKYQGTGLGLSICKSLAELMDGSVGYSPNPNASGSVFWFTAKMGGRSVTPPSKSPSVSGSPYPRSCFEMRSIAPRKHVLLVEDNIVNHTRYVEAPTYQFGFQRIDGAWNGAEAVRMVRQKPLSYDIILMDVSMPVLDGLAATEQIRDMGLTMPIIAITGNAMKGDAETYIAQGMDDCICKPVHRDQLLRVLWKWFGRSPQSQHGYWTETRRYAFICMSWRQERYHGKSIYAAYRDL

SEQ ID NO: 26960 - protein, 426 aa, Pichia pastoris
MSGDHKSFTVFNQEFIIDRDFELIKALGQGAYGVVCSAQYKGNEDGGKVAIKKVTNIFSKKILAKRALREIKLLRHFRGHKYITCLYDLDVIPDQNNNFNEIYLYEELMECDLHHIIKSKQPLTDSHYQSFIYQILGGLKYIHSADVLHRDLKPVNLLVNSDCELKICDFGLARGYSSDAEKNAGFLTEYVATRWYRAPEIILSFQTYTKAIDIWSVGCILAELLGGRPIFRGRDYVDQLNLILSTLGTVSEETLQSIRSERAQDYVRSLPFMPKIPFSQLFPGANPEAIDLLDRMLTVDPTHRITVTEALEHPYLKVWHDPNDEPVCSSKFDFSFEVVDDIETMKQMIVDEVLSLREFVRRPIQEQQLPFTEPDKHFDVSFDQPQIEPPAENYRDDHLPRPHELESQILDLEHELQYGLDRYGTQ

SEQ ID NO: 26961 - protein, 322 aa, Homo sapiens
VSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAIFGGFKSKESVPKLVADFMAKKFSLDALITNILPFEKINEGFDLLRSGKSIRTVLTF

SEQ ID NO: 26962 - protein, 380 aa, Homo sapiens
MGTKGKVIKCKAAIAWEAGKPLCIEEVEVAPPKAHEVRIQIIATSLCHTDASVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIF

SEQ ID NO: 26963 - protein, 212 aa, Triticum aestivum
DLANLVIVAGDHGKESKDREEQAEFKRMYSLIEEYKLKGHIRWISAQMNRVRNGELYRYICDTKGAFVQPAFYEAFGLTVIEAMTCGLPTIATCHGGPAEIIVNGVSGLHIDPYHSDKAADILVNFFEKCSEDPSYWDKMSEGGLKRIYEKYTWKLYSERLMTLTGVYGFWKYVSNLERRETRRYLEMFYALKYRSLAAAVPLAVDGESSDN

SEQ ID NO: 26964 - protein, 235 aa, Triticum aestivum
ARLDRVKNMTGLVEMYGRNPRLQELVNLVVVCGDHGKVSKDKEEQAEFKKMFDLIEQYNLIGHIRWISAQMNRVRNGELYRYICDMKGAFVQPAFYEAFGLTVIEAMTCGLPTFATAYGGPAEIIVHGVSGYHIDPYQNDKASALLVDFFGKCQEDPSHWNKISQGGLQRIEEKYTWKLYSERLMTLSGVYRFWKYVSNLDRRETRRYLEMLYALKYRKMAATVPLAVEGETSGK

SEQ ID NO: 26965 - protein, 379 aa, Zea mays; identical to SEQ ID NO: 6227

SEQ ID NO: 26966 - protein, 74 aa, Pyrus pyrifolia
LGEAGVGAAGTFALHEKHKEKKDPEHAHKHKIEEEIAAAAAVGSGGYAFHEHHEKKETKEEEEEAHGNKKHHLF

SEQ ID NO: 26967 - protein, 482 aa, Schizosaccharomyces pombe
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKHEEW

SEQ ID NO: 26968 - protein, 471 aa, Saccharomyces cerevisiae
MFLLYLFTSFAAVSGVLGSSPSYNGLGLTPQMGWDNWNTFACDVSEQLLLDTADRISEIGLKDLGYTYVILDDCWSSGRTANGTLVADKEKFPNGMSHVADHLHNNNFLFGMYSSAGEYTCAGYPGSLGHEEEDAEFFASNGVDYLKYDNCYNKGQFGAPETSYKRYKAMSDALNKTGRPIFYSLCNWGQDLTHYWGSDIANSWRMSGDIYPQFTRPDSRCPCDGDQFDCAYAGFHCSIMNILNKAAPMGQNAGIGGWNDLDNLEVGVGNLTDDEEKAHFSMWAMVKSPLVIGADVNHLKASSYSIYSQASVIAINQDPKGVPATRVWRHQVPQTDKYGQGEIQFWSGPLDNGDQVIALLNGGIKPRPMNTNLEEIFFDSYLGFEQLSSNWDIYDLWANRVDNATSANILNNNSVGNATIYNATALSYKDGMAKNDTRLFGTKIGSISPDGLLNTTVPAHGIAFYRLRRST

SEQ ID NO: 26969 - protein, 70 aa, Medicago sativa
RSTGEVVLGDATLGAIHIQKGVVDPHFVVVKEALLKTIKEAAADKWSEELSTAWEVAYDGLAASIKKSMS

SEQ ID NO: 26970 - protein, 575 aa, Lactobacillus casei
MAEHLKGIAASDGIATAKAYLLVQPDLSFQKKTVDDPSKEIDRLKQSLDQSNDELKVIRAKAAESLGEEEAQVFDAHMMILADPDFTGQVETKIKDEKVNAEQALKEVSEFFIKTFEGMTDNPYMQERAADVRDVTKRIMAHLLGRNLPNPALIDEEVVVVAHDLTPSDTAQLNKKYVKAFVTDIGGRTAHSAIMARSLEIPAVVGTDDITKKANNGDLISVDGLTGEVVVDPTDDEVAKFKQDAEAFAKQKAEWALLKTAKSITADGKHFDVAANIGTPKDLDGVLANGAEGIGLYRTEFLYMDSAELPTEDDQFEAYKKVVETMSPKPVVVRTMDIGGDKHLPYLPLPEEQNPFLGYRAIRISLDRQDIFRTQLRALLRASAFGNLRIMFPMIATIAEFKQARQIFTEEKDKLVKDGVKVSDDIQLGIMIEIPAAAVLADQFAKYVDFFSIGTNDLIQYSMAADRGNEHVSYLYQPYNPSILRLIKHVIDSAHKEGKWAGMCGEAAGDPIMVPLLLGMGLDEYSMSATSVLKVRSLMKKLSTADMAKMDEIALNQNITNDENADLVKKTTGQK

SEQ ID NO: 26971 - protein, 470 aa, Lactobacillus casei
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 26972 - protein, 194 aa, Saccharomyces cerevisiae
ISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEVKHQSKYSDKSKEKLLKKRKKKERGCNNL

SEQ ID NO: 26973 - protein, 376 aa, Catharanthus roseus
MALLDQASNLSPMPFDFTRKRKSRRRDGTKNVAETLAKWKEYNEKLDALDGGKPARKVPAKGSKKGCMKGKGGPENSHCKYRGVRQRTWGKWVAEIREPNRGSRLWLGTFRNAIEAALAYDEAARAMYGPCARLNLPNYRASEESSSLPTTSGSDTTTASGISEVSVYEDKKFTPVVSGLKQDDKGESLESADSKPQLLVDAGTPMSAVKEEPKEYQVMDSQSEGQFGDEEPPSKLVCKEVDFGQDQAVVPAVKNAEEMGGEMGGDILKGCSLSEMFDVDELLSVLDSTPLHASDFQHGMGNGNVKAEAAYNYAPSWDSAFQLQNQDPKLGSQQHMAQTPPEINSGLDFLQPGRQEDSYFTLGDLDFLDLGAELGL

SEQ ID NO: 26974 - protein, 210 aa, Catharanthus roseus
MYQSNAHNSDHLTFLPPLVDYQFLNNDFDFSEIFTDFNYANYNYNTSTSDNFSGFQFNENCEEIISPNYASEDLSDIILTDIFKDQDNYEDEVVAGEQEEELITTPTSRGGGGGGCEQRSNEEWIRYRGVRRRPWGKFAAEIRDPKRKGSRIWLGTYETAEDAALAFDQAAFQLRGSRARLNFPNLIGSANAPVRVSPRRRSSSCHLRPQ

SEQ ID NO: 26975 - protein, 353 aa, Pseudomonas fluorescens
MYPKNAWYVACTPDELQGQALGPARSAAKRMVFYRAHEGRVAAVEDFCPHRGAPLSLGYVENGNLVCGYHGLVMGCDGKTVEMPGQRVRGFPCNKTFAAVERYGFIWVWPGDQALADPALIHHLEWADNDQWAYGGGLFHIQCDYRLMIDNLMDLTHETYVHASSIGQKEIDEAPPQTTVDGDQVVTARHMHNVMPPPFWRMALRGNQLADDVPVDRWQICRFSPPSHVLIEVGVAHAGHGGYDASAQYKASSIVVDFITPESDTSIWYFWGMARNFNPQDQALTESIREGQGKIFSEDLEMLERQQQNLLAQPQRSLLKLNIDAGGVQSRRVLERLIAQEPEPREALIAASR

SEQ ID NO: 26976 - protein, 508 aa, Lycopersicon peruvianum
MNPFDKKQEPDTDSKTPFLTEMDSEFAAFSPISLPFADPSSPFINFGSFATPLSQHPVGEGEREGEGEGGEIEQPAEGGLGVPQPMECLHGIQIPPFLSKTFDLVEDPLLDTIISWGTNGESFVVWDPVEFSRLVLPRNFKHSNFSSFVRQLNTYGFRKIDADRWEFANEGFSRGKRHLLKNIQRRRSQQGGSSSGSSAEAGKGTMDEIEKLRNEKSLMMQEVVELQQQQHGTVQLMESVNEKLQAAEQRQKQMVSFLAKVLQNPTFLARVRQMKEQGEITSPRTMRKFVKHQSHGPDGVGSSSMEGQIVKFRSDFQDLAGCFDSPDFNPVVDQQLPETGLGAEAMPFEGGPVADGLTVAHELLNCSDREIRGASFFNSGGSQFKGKNVASPQIEVMPEYFASFPEEMGKEKNISGFSAPAIGSMVKDEELWGMGFEASAGMPSTGPELWDSLSSYVPDFGVSSGLSDLWDIDPLQVAGSSGVDKWPADGSPFGQSESHANQPKNDSF

SEQ ID NO: 26977 - protein, 297 aa, Erwinia chrysanthemi
MKLKDFAFYAPCVWGTTYFVTTQFLPADKPLLAALIRALPAGIILILGKTLPPVGWLWRLFVLGALNIGVFFVMLFFAAYRLPGGVVALVGSLQPLIVILLSFLLLTQPVLKKQMVAAVAGGIGIALLISLPKAPLNPAGLVASALATVSMASGLVLTKKWGRPAGMTMLTFTGWQLFCGGLVILPVQMLTEPLPDVVTLTNLAGYFYLAIPGSLLAYFMWFSGIEANSPVMMSMLGFLSPLVALFLGFLFLQQGLSGAQLVGVVFIFSAIIIVQDVSLFSRRKKVKQLEQSDCAVK

SEQ ID NO: 26978 - protein, 245 aa, Rhizobium leguminosarum
MLDLSGRKALVTGASGGIGEEIARLLHRQGAIVGLHGTRVEKLEALAADLGERVKIFPANLSDRDEVKALGQKAEADLEGVDILVNNAGITRDGLFVRMSDEDWDSVIEVNLTATFRLTRELTHPMMRRRYGRIINITSVVGVTGNPGQANYCASKAGMIGFTKSLAQEIATRNVTVNCVAPGFIESAMTGKLNDKQKEAIMGAIPMKRMGTGGEVASAVAYLASSEAAYMTGQTLHVNGGMAMI

SEQ ID NO: 26979 - protein, 363 aa, Leishmania major
MAQLVPLAELPSGKKIYSVRGQRFEVDREYDLVKVVGFGACGTVCSAVANGSGERVAIKRLSRVFGDLREGKRILREMEIMTSLKHNNLIRLHHFMRPQSKETFEDIYLVMDLYDTDLNRIIRSRQKLTDEHLQYFMIQAFRGLHYLHSAKVMHRDLKPSNLLVNADCALAICDFGLARDDQVMSSSDLTQYVVTRWYRPPEVLGMGSNQYTSAVDVWSLGLIFAELMVGRALLPGTDYIGQLVMIVNLLGSPSIDDMEFLSSEAKAFILSQPHRPALSFRDLFSMATEEATDLLSKLLVFHPARRLTAKQVMEHPYFSKYRDAAEEADAPDPFVWNHSHIETKEQLREDLWRVVEAHSQLNE

SEQ ID NO: 26980 - protein, 429 aa, Leishmania major
MPIRKVYAREVLDSRGNPTVEVELMTEAGVFRSAVPSGASTGVHEACELRDGDKARYCGAGCTQAVKNVNEILAPALVGKEESDQAGLDKMMCELDGTKNKSKLGANAILGCSMAISKAAAAKAGVPLYRYIASLAGTKDIRLPVPCFNVINGGKHAGNILPFQEFMIAPTKATSFREALRMGSEVYHALKVIIKSKYGQDAVNVGDEGGFAPPIKHIDEPLPILMEAIEKAGHKGKFAICMDCAASEAYDAERKMYNLTFKNPEPTYVSAAELQATYERWVAEYPLVSIEDPFAEDNFDEFSAITKALAGKAQIVGDDLTVTNVKRVTMAIEKSACNSLLLKINQIGTISESIAAAKLCMENGWSVMVSHRSGETEDTYIADLSVGLGTGQIKTGAPCRGERTAKLNQLLRIEEEIGSTATYGYPGWA

SEQ ID NO: 26981 - protein, 321 aa, Leishmania major
MSTEHARNLLYLALNAFSSIGIVYTNKVIFTRHGFSYGTLLTVIHFFITTLGLFICRMMGVFEPKRIPVLKILPLCVGFCGFVALNNVSLVYNSIGFYQLMKVLTTPMLVVIQTLFYQKTFSAKVKLSLTVTCIGVGLSTVSDTSANLAGTVVALSTLLITCMYQIWVGTKQSEFQCDGFQLLYNQAPISCAMLMPMAYFADDLANKYYTPCWPTIIVIIFSGLLAFFVNISIFLVIGKTSPVTYNVLGHFKLCVILFLGFLWFGDQMNARIFLGIVITLFGVFWYTHLKMQEEKKEERAQILAKHAEEHVNVGEGDEKYV

SEQ ID NO: 26982 - protein, 377 aa, Rattus norvegicus
MGTQGKVITCKAAIAWKTDSPLCIEEIEVSPPKAHEVRIKVIATCVCPTDINATNPKKKALFPVVLGHECAGIVESVGPGVTNFKPGDKVIPFFAPQCKKCKLCLSPLTNLCGKLRNFKYPTIDQELMEDRTSRFTSKERSIYHFMGVSSFSQYTVVSEANLARVDDEANLERVCLIGCGFTSGYGAAINTAKVTPGSACAVFGLGCVGLSAVIGCKIAGASRIIAIDINSEKFPKAKALGATDCLNPRDLDKPVQDVITELTGGGVDFSLDCAGTAQTLKAAVDCTVVGWGSCTVVGAKVDEMNISTVDMILGRSVKGTFFGGWKSVDSVPNLVTDYKNKKFDLDLLVTHALPFDKINDAIDLMNQGKSIRTILTF

SEQ ID NO: 26983 - protein, 432 aa, Rattus norvegicus
MADKLPYKVADIGLAAWGRKALDIAENEMPGLMRMREMYSASKPLKGARIAGCLHMTVETAVLIETLVALGAEVRWSSCNIFSTQDHAAAAIAKAGIPVFAWKGETDEEYLWCIEQTLHFKDGPLNMILDDGGDLTNLIHTKHPQLLSGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYLLKNGHRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 26984 - protein, 343 aa, Rattus norvegicus
MLLLKKQTEDISSVYEIREKLGSGAFSEVMLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALQHLWISGDAALDRDILGSVSEQIQKNFARTHWKRAFNATSFLRHIRKLGQSPEGEEASRQGMTRHSHPGLGTSQSPKW

SEQ ID NO: 26985 - protein, 380 aa, Rattus norvegicus
MAAAAAAPGGGGGEPRGTAGVVPVVPGEVEVVKGQPFDVGPRYTQLQYIGEGAYGMVSSAYDHVRKTRVAIKKISPFEHQTYCQRTLREIQILLGFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEAP

SEQ ID NO: 26986 - protein, 381 aa, Mus musculus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSAQMQQ

SEQ ID NO: 26987 - protein, 187 aa, Rattus norvegicus
MAADISQWAGPLSLQEVDEPPQHALRVDYGGVTVDELGKVLTPTQVMNRPSSISWDGLDPGKLYTLVLTDPDAPSRKDPKFREWHHFLVVNMKGNDISSGTVLSEYVGSGPPKDTGLHRYVWLVYEQEQPLNCDEPILSNKSGDNRGKFKVESFRKKYHLGAPVAGTCFQAEWDDSVPKLHDQLAGK

SEQ ID NO: 26988 - protein, 756 aa, Rattus norvegicus
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKLQHWIHSCLRKADKNKDNKMNFKELKDFLKELNIQVDDGYARKIFRECDHSQTDSLEDEEIETFYKMLTQRAEIDRAFEEAAGSAETLSVERLVTFLQHQQREEEAGPALALSLIERYEPSETAKAQRQMTKDGFLMYLLSADGNAFSLAHRRVYQDMDQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMARHLRAILGPILLDQPLDGVTTSLPSPEQLKGKILLKGKKLGGLLPAGGENGSEATDVSDEVEAAEMEDEAVRSQVQHKPKEDKLKLVPELSDMIIYCKSVHFGGFSSPGTSGQAFYEMASFSESRALRLLQESGNGFVRHNVSCLSRIYPAGWRTDSSNYSPVEMWNGGCQIVALNFQTPGPEMDVYLGCFQDNGGCGYVLKPAFLRDPNTTFNSRALTQGPWWRPERLRVRIISGQQLPKVNKNKNSIVDPKVIVEIHGVGRDTGSRQTAVITNNGFNPRWDMEFEFEVTVPDLALVRFMVEDYDSSSKNDFIGQSTIPWNSLKQGYRHVHLLSKNGDQHPSATLFVKISIQD

SEQ ID NO: 26989 - protein, 354 aa, Rattus norvegicus
MGCTLSAEERAALERSKAIEKNLKEDGISAAKDVKLLLLGAGESGKSTIVKQMKIIHEDGFSGEDVKQYKPVVYSNTIQSLAAIVRAMDTLGVEYGDKERKADSKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYPGSNTYEDAAAYIQTQFESKNRSPNKEIYCHMTCATDTNNIQVVFDAVTDIIIANNLRGCGLY

SEQ ID NO: 26990 - protein, 423 aa, Rattus norvegicus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSDAAVSSKATPSQSSSINDISSMSTEHTLASDTDSSLDASTGPLEGCR

SEQ ID NO: 26991 - protein, 493 aa, Rattus norvegicus
MGTAKVTPSLVFAVTVATIGSFQFGYNTGVINAPETIIKDFLNYTLEERLEDLPREGLLTTLWSLCVAIFSVGGMIGSFSVGLFVNRFGRRNSMLLVNLIAILGGCLMGFAKIAESVEMLILGRLIIGIFCGLCTGFVPMYIGEVSPTALRGAFGTLNQLGIVVGILVAQVFGLDFILGSEELWPGLLGLTIIPAILQSAALPFCPESPRFLLINRKEEDQATEILQRLWGTPDVIQEIQEMKDESIRMSQEKQVTVLELFKSPSYFQPLLISVVLQLSQQFSGINAVFYYSTGIFQDAGVQEPIYATIGAGVVNTIFTVVSLFLVERAGRRTLHMIGLGGMAVCSVFMTISLLLKDEYEAMSFVCIVAILVYVAFFEIGPGPIPWFIVAELFSQGPRPAAMAVAGCSNWTSNFLVGMFFPSAAAYLGAYVFIIFAAFLVFFLIFTSFKVPETKGRTFEDITRAFEGQAHSGKGSAGVELNSMQPVKETPGNA

SEQ ID NO: 26992 - protein, 839 aa, Cricetulus griseus
MDESSELGGLETMDTLTELGDELTLGDIDEMLQFVSNQVGEFPDLFSEQLCSSFPGGGSSGSSSSSNSSSSSGSNSRGNGGAATDPGVQRSFSQVPLPTFSPSTASPQALALQVKVSPTPPRATPVLQPRPQPQPQPQPSAQLQQQTVMITPTFSTAPQTRIIQQPLIYQNAATSFQVLQAQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPLQTGALQVPTLVGSNGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDSDVDLKIEDFNQNVLLMSPPASDSGSQAGFSPYSIDSEPGSPLLDDAKKFQAPAKEICVGCQKTVYPMERLLANQQVFHISCFRCSYCNNKLSLGTYASLHGQIYCKPHFNQLFKSKGNYDEGFGHRPHKDLWANKSENEETSERSPQSPDVGEIPHNSGVEDAPISKVGVLAANMEAKASPQREKEDKPAETKKLRIAWPPPAELGSSGSTMEEGFKGSKPKWPPEDETSKTEALGDVDLDLKKLRRSSSLKERSRPFTVAASFRTSSLKSPKTLSPLRKGWSMSEQNEESGGGIVTAGKQTENAKAPGKKENVRKSRWQREDSAREEVARRSKDIHGVELESENFIENGANIYEGDSGDLVQQSPLDPKSPSWSGFVDTTPTEEFTTQNQKSHDVGFREGEVVRELSVEEQIKRNRYYDEDEDEE

SEQ ID NO: 26993 - protein, 66 aa, Tetrahymena thermophila
AGGKGGKGMGKVGAKRHSRKSNKASIEGITKPAIRRLARRGGVKRISSFIYDDMDVVYALKRQGRT

SEQ ID NO: 26994 - protein, 208 aa, Branchiostoma belcheri
MPFTAPQAPKCPKCGKSVYQAEERLAAGRSFHNTCFKCTMCNKMLDSTTVAEREDSLFCKTCYGKKFGPKGVGFGQGAGALGMDSGERFGNKPTESTAPMTGAAYLNVGKSSEPAKPSKYGSTAEKCPRCGGSVYPAEKVIGAGKSWHKVCFKCSACNKALDSTNVCDREGEIYCKACYARGFGPSGLRAGQGAGVRTQTKAPSASVI

SEQ ID NO: 26995 - protein, 101 aa, Caenorhabditis elegans
SERGKGGKGLGKGGAKRHRKVLRDNIQITKPAIRRLARRGGVKRISGLIYEETRGVLKVFLENVIRDAVTYCEHAKRKTVTAMDVVYALKRQGRTLYGFGG

SEQ ID NO: 26996 - protein, 605 aa, Hordeum vulgare subsp. vulgare
LEEELSLDASEIVIASTRQEIEEQWNLYDGFEVILARKLRARVKRGANCYGRYMPRMVIIPPGVEFGHIVHDFDIDGEEENHGPASEDPPIWSQIMRFFTNPRKPMILAVARPYPEKNITTLVKAFGECRPLRELANLTLIMGNREAISKMHNTSASVLTSVLTLIDEYDLYGQVAYPKHHKHSEVPDIYRLATRTKGAFVNVAYFEQFGVTLIEAAMNGLPVIATKNGAPVEIHQVLNNGLLVDPHDQNAIADALYKLLSEKQLWSRCRENGLKNIHQFSWPEHCKNHLSRILTLGMRSPAVGSKEERSKAPISGRKHIIVISVDSVNKEDLVRIIRNAIEAAHTENTPALTGFVLSTSLTISEICSLLVSVGMHPAGFDAFICNSGSSIYYPSYSGNTPSNSKVTHVIDRNHQSHIEYRWGGEGLRKYLVKWATSVVERKGRIERQMIFEDSEHSSTYCLAFKVVNPNHLPPLKELRKLMRIQSLRCNALYNHSATRLSVTPIHASRSQAIRYLFVRWGIELPNIVVIVGESGDSDYEELLGGLHRTIILKGDFNIAANRIHTVRRYPLQDVVALDSSNIIEVQGCTTEDIKSALRHIGVPTQ

SEQ ID NO: 26997 - protein, 255 aa, Pseudomonas sp. GM101
MLNGKTALITGSTSGIGLGIAEVLARNGASVILNGFGDWQAAAEQLARHEGRVGYHAADLADPAQIEALFDYARREFGRVDILVNNAGIQHVAPLQDFPAERWDAILALNLSAVFHCTRLALPDMRAQDWGRIINIASVHGSIGSLGKAAYVAAKHGVLGLTKVVALETALSGVTCNAICPGWVLTPLVQRQIDARIAAGESPEQARTALLAEKQPSQAFVTPQQLGELALFLCSSAAQQVRGAAWNIDGGWLAQ

SEQ ID NO: 26998 - protein, 381 aa, Oryza sativa (japonica cultivar-group)
MMHGLEEITTRELDEDDNVEAKGGGGAGAGAGAAMDVDSVECLSLPDSSSSSGAGAGGGGGGGGGGGVGAMDAADDVGLALHAHGALLAAAAAARAAACSKGGGGGGAAAGSGVHELLECPVCTNSMYPPIHQCQNGHTLCSTCKARVHNRCPTCRQELGDIRCLALEKVAESLELPCKYCSLGCPEIFPYYSKIKHEAQCMFRPYNCPYAGSECAVVGDIPYLVAHLRDDHKVDMHSGCTFNHRYVKSNPREVENATWMLTVFHCFGQYFCLHFEAFQLGMAPVYMAFLRFMGDENEARNYSYSLEVGANGRKMVWEGTPRSVRDSHRKVRDSHDGLIIQRNMALFFSGGDRKELKLRITGRIWKEQQTPDGACIPNLCS

SEQ ID NO: 26999 - protein, 352 aa, Rhizobium leguminosarum bv. viciae
MPDIRDVEIIAPNFKRRLSGVTSTIVQLIPCQIRLGIKIATLGPGLPEDLPKLKWRQLLGLWRPPARRRRRVWHARRNNEMAVGILLRHLTRMPLKLLFTSAAQRRHTAYTKWLIRRMDAVIATSDRSGSFLEVPHTVIQHGVDLALFHPPEAAEDGIAATGLPGRHLVGCFGRVRHQKGTDLFVRAMIELLPQHTEWTAVVSGRVTAEHVAFADKLKADVVAAGLSDRILFLGEVPDIKIWYRRLTLYVAPSRNEGFGLTPLEAMASRTAVVASDAGAYAELIVTGETGSVVAASDGEALTRAIAPYIADPALAVAHGENALRHVRANFALEREASAIGAVYNSLLGDNRS

SEQ ID NO: 27000 - protein, 462 aa, Zymomonas mobilis
MAIELKMPALSPTMEEGTLTRWLVKEGDSIKAGEILAEIETDKAIMEFEAVDEGVITKILIPEGSENVKVGTAIAYLGTDANDVTLEGASAETKAEESAPVASPAKTEAAALEEAATPSLGKVINSAPEIPEGTEFFQQTLREALRDAMAEEMRRDDRVFVMGEEVAEYQGAYKVTQGLLQEFGARRVVDTPISEYGFSGIGVGAAMEGLRPVIEFMTMNFSMQAIDHIINSAAKTHYMSGGQVRCPIVFRGPNGAAPRVGAQHTQNFGPWYAAVPGLVVLAPYDAIDAKGLLKAAIRSDDPVVFLECELLYGKTFDVPKMDDFVLPIGKARIIREGKDVTIVSYSIGVSFALTAAEALAKEGIDAEVIDLRTLRPLDKETILQSLAKTNRIVTVEDGWPVCSISSEIAAIAMEEGFDNLDAPVLRVTNADTPTPYAENLEKKGLVNPEAIIEAVRKVCYRK

SEQ ID NO: 27001 - protein, 492 aa, Oncorhynchus mykiss
MDSGGKQVTFQLMLTVGAAVIGSLQFGYNTGVINAPQKVIERFLNETWFDRYQEPISKTSLTTLWSVSVAIFSVGGIFGSFSVGLFVNRFGRRNSMLMANVLAFVSAALMGFSKMGGSWEMLIIGRFVVGLYSGLSTGFVPMYVGEVAPTALRGALGTLHQLGIVTGILMAQVFGMEALMGNASLWPFLLGFTFIPALAQCALLPFCPESPGFLLINRNEENKAKTVLKKLRGTTDVSADMQEMKEEARQMMREKKVTILELFRSPLYRQPIFIAIMLQLSQQLSGINAVFYYSTRIFEKAGVAQPVYATIGAGVVNTAFTVVSLFVVERAGRRSLHLLGLIGMAGAAVLMTIALALLDKLPWMSYVSIVAIFAFVAFFEIGPGPIPWFIVAELFSQGPPPSAFAVAGFSNWTANFIVGMAFQYVEELCGPYVFVIFTILLLSFFIFTYFKVPETKGRTFDEISAGFRQSSGTGGEKHSPEELNSLGADSQL

SEQ ID NO: 27002 - protein, 478 aa, Cyprinus carpio
MLAVGTAVIGSLQFGYNTGVINAPQNVIEKFYNETWLDRYQEIIPKTTMTTLWSLSVAIFSVGGIVGSFSVGLFVNRFGRRNSMLMANVLAFISAALMGFSKNAASWEMLIIGRFVVGLYSGLATGFVPMYVGEVSPTALRGALGTLHQLGIVVGILMAQIFGMDVIMGNDTMWPFLLCFTFIPAVLQCCLLPFCPESPRFLLIIRNEENKAKSVLKKLRGTSDVAADMQEMKEESRQMMREKKVTIPELFRSPLYRQPMIICIMLQLSQQLSGINAVFYYSTKIFQKPGVEQPVYATIGAGVVNTAFTVVSLFVVERAGRRSLHFLGLLGMAGSAVLMTIALALLENVPWMSYISIVAIFGFVAFFEIGPGPIPWFIVAELFSQGPRLRLSVAGLCNWTANFIVGMCFQYVEELCGPYVFIIFTIFLLGFFVFTYFKVPETKGRTFDEISAGFRQAASAAEKHSPEELNSLGADSQL

SEQ ID NO: 27003 - protein, 247 aa, Petunia integrifolia subsp. inflata
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRDLKNLEGKLEKAIGRVRSKKNELLFSEIELMQKREIEMQNANMYLRAKIAEVERATQQMNLMPGGGSEYQQQPMSSTSQPYDARNFLPVNLLEPNPHYSRQDQTALQLV

SEQ ID NO: 27004 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 27005 - protein, 527 aa, Drosophila melanogaster
MAKMPETTFADLSLADKTAVKKSSIEARRFSDVSTCSFSSTCFTGSSDEEDVSPKDNHQRNSAGGTDFCVKSISKSAFGRREIEIAESEMPGIMTLRKRAKDEKPLKGANIVGCTHVNAQSAVLIEALVQLGATVRWAACNIYSTQNAVAAALAEAGIPIFAWRGETEEEFWWCLDRAIYSDGWQPNLILDDGGDATHLMLKKYPDYFKAIRGIVEESVTGVHRLYMLSKGGKLTVPAINVNDSVTKNKFDTFYTCRDSILDSLKRTTDIMFGGKQVVICGYGDVGKGCAQSLKGQGCIVYVTEVDPICALQAAMDGFRVVRLNEVIRTVDVVVTATGNKNVITRDHMNRMKNGCILCNMGHSCSEIDVNGLHTPELTWERVRSQVDHIRWPDGRMIILLAEGRLVNLSCSTISSFVVSVASSTQALALIELFSAPGRYKSDVYLLPKKMDEYVASLHLATFDAHLTELTDEQSKFMGLNKAGLLKPITTGWLPFFPFQFCTLVNNILISFADINQYLMLYPVILVL

SEQ ID NO: 27006 - protein, 1095 aa, Drosophila melanogaster
MTKKYEFDWIIPVPPELTTGCVFDRWFENEKETKENDFERDALFKVDEYGFFLYWKSEGRDGDVIELCQVSDIRAGGTPKDPKILDKVTKKNGTNIPELDKRSLTICSNTDYINITYHHVICPDAATAKSWQKNLRLITHNNRATNVCPRVNLMKHWMRLSYCVEKSGKIPVKTLAKTFASGKTEKLVYTCIKDAGLPDDKNATMTKEQFTFDKFYALYHKVCPRNDIEELFTSITKGKQDFISLEQFIQFMNDKQRDPRMNEILYPLYEEKRCTEIINDYELDEEKKKNVQMSLDGFKRYLMSDENAPVFLDRLDFYMEMDQPLAHYYINSSHNTYLSGRQIGGKSSVEMYRQTLLAGCRCVELDCWNGKGEDEEPIVTHGHAYCTEILFKDCIQAIADCAFVSSEYPVILSFENHCNRAQQYKLAKYCDDFFGDLLLKEPLPDRPLDPGLPLPPPCKLKRKILIKNKRMKPEVEKVELELWLKGELKTDDDPEEDASAGKPPEAAAAPAPAPEAAAAAEGAAEGGGGAEAEAAAANYSGSTTNVHPWLSSMVNYAQPIKFQGFDKAIEKNIAHNMSSFAYLKQSSIDESAGMNFVNYNKRQMSRIYPKGTRADSSNYMPQVFWNAGCQMVSLNFQSSDLPMQLNQGKFEYNGGCGYLLKPDFMRRADKDFDPFADAPVDGVIAAQCSVKVIAGQFLSDKKVGTYVEVDMFGLPSDTVKKEFRTRLVANNGLNPVYNEDPFVFRKVVLPDLAVLRFGVYEESGKILGQRILPLDGLQAGYRHVSLRTEANFPMSLPMLFVNIELKIYVPDGFEDFMAMLSDPRGFAGAAKQQNEQMKALGIEEQSGGAARDAGKAKEEEKKEPPLVFEPVTLESLRQEKGFQKVGKKQIKELDTLRKKHAKERTSVQKTQNAAIDKLIKGKSKDDIRNDANIKNSINDQTKQWTDMIARHRKEEWDMLRQHVQDSQDAMKALMLTVQAAQIKQLEDRHARDIKDLNAKQAKMSADTAKEVQNDKTLKTKNEKDRRLREKRQNNVKRFMEEKKQIGVKQGRAMEKLKLAHSKQIEEFSTDVQKLMDMYKIEEEAYKTQGKTEFCA

SEQ ID NO: 27007 - protein, 236 aa, Pinus taeda
MAFNVFYVYMLVWLCIASFCNGEEPVVDTVLATAPAAPTAKPPTTAPAAPVSTPKPPTTTPVAPAVAPTKPAPPVAPAVAPTKPAPPVTAPTKAPPPTTKPPAVAPAKAPVSAPPVATPPVAVPPVATPPVAAPPVAVPPASPPAIPPPVQAPAPSHHKRKKKKKKHHHGSAPAPTPSALKSPPSPPLGSPGPSTSADLFSPAPTPPSAGMKSFAASMGGTLVIVLASSLVLSLSR

SEQ ID NO: 27008 - protein, 212 aa, Nicotiana tabacum
MAFTGTLDKCSACDKTVYFVDLLSADGVTYHKSCFKCSHCKGTLVMSNYSSMEGVLYCKHHFEQLFKESGNFTKNFQNSKAERQNSLTRAPSKLSAMFSGTQDKCAACDKTVYPLEKVTMEGESFHKSCFKCAHGGCPLTHATYASLDGNLYCKHHFAQLFMEKGNYQHVLKAANNKKSSAAVTPVNETEENAAEEENNKEPENAEEPQQQS

SEQ ID NO: 27009 - protein, 486 aa, Mycobacterium vanbaalenii
MISANLIINGREETSDRTIDVVSPADIRVLLGSVPDAAPGQVDEAVAAAAMAFPEWSSRPLEERQGALLAAAGTIHDMIEEYAPILSRENGKILEESHVDLEFASGICGYTAGISAEILADQQIRDTGGTTLIRRRPIGPVAAITPWNFPVVLAFLKLAPALVAGNTVVLKPAANSPLVLAEIIRALQQHFPPGVLNMVTGGDAVGEALVAHPRIRKIGFTGGIDTGRKVMAAAARDIKRVTLELGGNDPAILLDDVDLSPETMRQIVKGAFGTTGQVCFGLKRIYVPTRIHDRFVEAFSAAVDEIVVGPGDDPRVTMGPLNNAQQKNLVEKIVDDARSSGATVTTLGQRLDSAAWDHGHFMMPSVVTAADPRLAIVEEEQFGPVVPVLKYDELDDVIRLVNQSQYGLAASIWTSDEERAFLLGRRFDTGSVFINSHTFTSLDPRAPFGGAKASGLGREFSPASLDSYTELQTISRRIGPPGPPLS

SEQ ID NO: 27010 - protein, 321 aa, Zea mays
MTMIYATVRRPGSYSDGSEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWLKFMNADNQHLVSPEAIDFLDKLLRYDHQERLTALEAMTHPYFQQVRAAENSRTRA

SEQ ID NO: 27011 - protein, 625 aa, Xenopus laevis
MDTYQKPEDKELQGLRDVANRLRIHSIRATCASNSGHPTSCCSAAEVLSVLFFNTMRYEAGDPANANNDRFVLSKGHAAPILYAAWAEAGFIKQSDLLNLRKIDCDLEGHPTPKLPFVDVATGSLGQGLGASCGMAYTGKYFDKASYRVYCLLGDGESSEGAVWEAMAFASHYHLDNLVAIFDVNRLGQSEAAPLQHQTDIYMKRCEAFGWNTYVVDGHDVAELCHAFWQAAHVKDKPTAIIAKTFKGKGISGVENEDNWHGKPMPKDKVESIINEIQNRIQTNKKICPLVPTADAPKISISGIAFPSPPNYKIGDKIATRKAYGLALAKLGHANSRVIALDGDTKNSTFSDIFKKEHPDRYIECFIAEQNMVSVAMGCATRGRTVAFASTFAAFLSRAYDHIRMGAISQSNVNLCGSHCGVSIGEDGPSQMALEDLSMFRAIPTCTVFYPSDGVSTEHAVFLSANTPGICFIRTSRPDTAVIYSPEEKFEIGQAKVVRQSSSDRVTVIGAGVTLHEALAAADELAKQGINIRVIDPFTIKPLDAATILSSGRATGGHIITVEDHYREGGIGEAVCAAVAGEPGFIVQTLAVRGVPRSGKPTELLDMFGISARCIVEAVKTTFAN

SEQ ID NO: 27012 - protein, 262 aa, Populus x canescens
MSPTESSREENVYMAKLAEQAERYEEMVEFMEKVAKTVDNEELTMEERNLLSVAYKNVIGARRASWRIISSIEQKEESRGNEDHVTIIKEYRGKIEAELCKICDGILSLLETHLVPSASAAESKVFYLKMKGDYHRYLAEFKTGAERKEAAESTLLSYKSAQDIALSELAPTHPIRLGLALNFSVFYYEILNSPDRACSLAKQAFDEAISELDTLGEESYKDSTLIMQLLRDNLTLWTSDITDDAGDEIKEASKRESGDGPQ

SEQ ID NO: 27013 - protein, 260 aa, Populus x canescens
MDSSKDRENFVYVAKLAEQAERYDEMVDAMKKVAKLDVELTVEERNLLSVGYKNVIGARRASWRILSSIEQKEESKGNETNVKRIKEYRQKVEAELTGICHDIMTVIDEHLIPSCTAGESTVFYYKMKGDYYRYLAEFKSGNERKEAADQSLKAYETATTTAASDLSPTHPIRLGLALNFSVFYYEIMNSPERACHLAKQAFDEAISELDTLSEESYKDSTLIMQLLRDNLTLWTSDIPEDGEDQKMETSARTGEGEDAE

SEQ ID NO: 27014 - protein, 35 aa, Pisaster ochraceus
MSGRGKGGKGLGKGGAKRHRKVLRDNIQGITKPAI

SEQ ID NO: 27015 - protein, 404 aa, Caenorhabditis elegans
RKEEKRKIHHSKETDYLRLKRTRLTVNDFESLKVIGRGAFGEVRLVQKHDTGHIYAMKILRKSEMVEKEQTAHVRAERDILSEADCDWVVKMYYSFQDYSNLYLVMEFLPGGDMMTLLIKKDTLTEEATQFYIAEAALAIQFIHSLGFIHRDIKPDNLLLDARGHVKLSDFGLCTGLKKFHRTDHYRNWPSTLPPDFISKPFESKRKAETWKRNRRAYAYSMVGTPDYIAPEVFQPNGYTKSCDWWSLGVIMYEMLIGYPPFCSELPQETYRKVINWQQTLVFPSDVPISIEAKATIKRFCCERERRLGNHGGLDEIKQCPFVKRIDWNHIRERPPPIRVTVKSIDDTSNFDDFPDEDLTWPTSTLIRPEEQPGRRGEFVDFTYKRFDGLTQKMRYSDLKKQAK

SEQ ID NO: 27016 - protein, 455 aa, Drosophila melanogaster
MMSSRTQDADGASIRFSDHTLDKATKAKVTLENYYSNLVTQYGERKQRLAKLEAQLKDESLSEAQRQEKRLQHAQKETEYLRLKRLRLGVEDFEALKVIGRGAFGEVRLVQKKDTGHVYAMKVLRKADMLEKEQVAHVRAERDVLVEADHQWVVKMYYSFQDPVNLYLIMEFLPGGDMMTLLMKKDTLSEEGTQFYISETALAIDSIHKLGFIHRDIKPDNLLLDARGHLKLSDFGLCTGLKKSHRTDFYRDLSQAKPSDFIGTCASPMDSKRRAESWKRNRRALAYSTVGTPDYIAPEVFLQTGYGPACDWWSLGVIMYEMLMGYPPFCSDNPQDTYRKVMNWRETLIFPPRDPISEEAKETIINFCCEADRRWVPASSGGSEVVPFFRGVDWEHILAAPYLEVRSIDDTSNFDEFPDVSLEIPSAPIPQGGEIAKDWVFINYTYKRFEVRNLE

SEQ ID NO: 27017 - protein, 303 aa, Lycopersicon pimpinellifolium
MRSKDSKETTYISDTTSYRFPVESSQIPFAALQEATNNFNCNSLIGLGGFGTVYRGVLCDGTKVALKRCKLESSQGIEEFQTEIEMLSHFRHPYLVSLIGYCDENNVTILIFKYMENGSLSSHLYGSYLPTMTWEQRLEICIGAARGLYYLHKNAVIHRDVKSANILLDENFVAKTTDFGVSKTRTELDQTHVSTVVKGTLGYLDPEYVIRGKLTEKSDVYSFGVVLFKVLCARSAIVHYISKGLVTLAAWAMDSHKKGQLEQIVDPNLASKIRPKYLNKFGETAVKCLADSGVDRPSVGDVL

SEQ ID NO: 27018 - protein, 319 aa, Lycopersicon pimpinellifolium
MGSKYSKATNSISDASNSRYGVPFENYRVPLVDLEEATNNFDDNFFIAEGGFGKVYRGVLRDGTKVALKRHNCDSQQSIEEFRTEIEILSRRSHPHLVSLIGYCDGRNEMILIYDYMENGNLKSHLYGSDLPSMSWEQRLEICIGAARGLHYLHTNGVMHRDVKSSNILLDENFVPKITDFGLSKTRPQLYQTHVSTDVKGTFGYIDPEYFIKGRLTEKSDVYSFGVVLFEVLCARSAIVQSLPSEMVNLAEWAVESHNNGQLEQIIDPNLAAKIRPESLRKFGETAVKCLALSSEDRPSMGDVLWKLEYALRLQESVI

SEQ ID NO: 27019 - protein, 323 aa, Lycopersicon pimpinellifolium
MGTNYSKPTTSINDASNLSNRVPFESFRVPFVDLQEATNNFDDKFLIGVGIFGKDYRGVLRDGTKVALKRHKPESPQGIEEFRTEIEILSHCSHPHLVSLIGYCDERNEMILIYEYMENGNLSKRLYGSDLCLPTMSWEQRLEICIGAARGLHYLHNSAVIHCDVKSTNILLDENFVAKITDFGISKTTPEFDQTHLSTVVQGSIGYIDPEYFIRGQLTKKSDVYSFGVVLFEVLCARPAIGRSHMISLAEWAVETQKMGQLEQIVDPTIVAKIRPESLRMFGETAVNCLASSSENRPSMGDVLWKLEYALRLQEPIIQDNPE

SEQ ID NO: 27020 - protein, 319 aa, Lycopersicon esculentum
MGSKYSKATNSISDASNSRYGVPFENYRVPLVDLEEATNNFDDNFFIAEGGFGKVYRGVLRDGTKVALKRHNCDSQQSIEEFRTEIDILSRRSHPHLVSLIGYCDERNEMILIYDYMENGNLKSHLYGSDLPSMSWEQRLEICIGAARVLHYLHTNGVMHRDVKSSNILLDENFVPKITDFGLSKTRPQLYQTHLSTVVQGTLGYLDPEYFIKGRLTEKSDVYSFGVVLFEVLCARSAIVQSLPREMVNLAEWAVESHNNGQLEQMVDPNLAAKIRPESLRKFGETAVKCLALSSEDRPSMGDVLWKLEYALRLQESVI

SEQ ID NO: 27021 - protein, 323 aa, Lycopersicon esculentum
MGTNYSKPTTSINDASNLSNRVPFESFRVPFVDLQEATNNFDDKFLIGVGIFGKVYRGVLRDGTKVALKRRKPESPQGIEEFRTEIEILSHCSHPHLVSLIGYCDERNEMILIYDYMENGNLSKRLYGSDLCLPTMSWEQRLEICIGAARGLHYLHNSAVIHRDVKSTNILLDENFVAKITDFGISKTTPEFDQTHLSTMVQGSIGYIDPEYFIRGQLTKKSDVYSFGVVLFEVLCARPAIGRSHMISLAEWAVETQKMGQLEQIVDPTIVAKIRPESLRMFGETAVKCLASSSENRPSMGDVLWKLEYALHLQEPIIQDNPE

SEQ ID NO: 27022 - protein, 820 aa, Mus musculus
MMLRWSGVWGFHPPRIFPSLLVVVALVGLLPVLRSHGLQHSPTASTIRGSEPPRERSIGDVTTAPSEPLHRPDDHNLTNLIIEHGGKPSRKAFPVLDIDYPHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLLYAVCLVGGEQINNIGLLDTLLFGSIISAVDPVAVLAVFEEIHINELLHILVFGESLLNDAVTVVLYHLFEEFASYDSVGISDIFLGFLSFFVVALGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHQWNWTFVISTLLFCLIARVLGVLVLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKAVTSDRILPALSKDKEEEIRKILRSNLQKTRQRLRSYNRHTLVADPYEEAWNQMLLRRQKARQLEQKITNYLTVPAHKLDSPTLSRARIGSDPLAYEPKADLPVITIDPASPQSPESVDLVNEELKGKVLGLNRGPRVTPEEEEEDEDGIIMIRSKEPSSPGTDDVFTPGSSDSPSSQRIQRCLSDPGPHPEPGEGEPFIPKGQ

SEQ ID NO: 27023 - protein, 351 aa, Ovis aries
MGNAAAAKKGSEQESVKEFLAKAKEDFLKKWENPAQNTAHLDQFERIKTLGTGSFGRVMLVKHTETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 27024 - protein, 343 aa, Ovis aries
MASNPNDVKEFLAKAKEDFLKKWENPAQNTAHLDQFERIKTLGTGSFGRVMLVKHTETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 27025 - protein, 367 aa, Homo sapiens
  unsure (1)..(367): unsure at all Xaa locations
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMXGXVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 27026 - protein, 299 aa, Dianthus caryophyllus
FIVLCGATHLINLWTFRIHTKTVEIVMTTAKLLTAVVSCVTALMLVHIIPDLLSVKTRELFLKNKAAQLDREMGLIRTQEETGRHVRMLTHEIRSTLDRHTILKTTLVELGRTLALEECALWMPTRTGLELQLAYTLRQQYPVDYTVPIQLPVITQVFSTNRAVKISPNSPVARIRPVMGKYMPGEVVAVRVPLLHLSNFQINDWPELSTKRYALMVLMLPSDSARQWHVHELELVEVVADQVAVALSHAAILEESMRAQQQLMEQNVALDLARREAETAIRARNDFLAVMNHEMRTPM

SEQ ID NO: 27027 - protein, 240 aa, Atriplex hortensis
MSYSYPPPLPSNTLNNFLSPKPVTMKTTGGPPKPTKLYRGVRQRHWGKWVAEIRLPKNRTRLWLGTFDTAEEAALAYDKAAYKLRGDFARLNFPNLRHEGSHIGGEFGEYKPLHSSVNAKLEAICESLAKQGNEKQGKSGKSKKKDVANNNNNTSSSSSSSCCTTATAAADAPQQQQRMPENGGDVKTESTSDSEVGSGGSSPLSDLTFGDNEEMGSENFLLESCPSHEIDWDAILSSES

SEQ ID NO: 27028 - protein, 108 aa, Clostridium beijerinckii
MYMIRAIIRPERVSTVLSELLDAGFPEVTKMAVYGRGKQKGIKVGEIYYDELPKEMLLIAVKDEDKDDVIKVIMRNSRTGEKGAFGDGKIFVAPIEEVYTVSSGKSGL

SEQ ID NO: 27029 - protein, 309 aa, Trichomonas vaginalis
MDIPQLGYGTFLATDPTKLKAALHYAIEECGVRNLDCAWGYNNQDVIGDTLKEIFDKGKIKREDIFITSKLWCTHHRPDLVEYELKETLQQLQLDYIDLWLMHMPIALQSRTDREYFPKDSNGKVIYEQIDILDTYKAMEECMKKGMTRHIGVSNFSIEQLERVWFNCDIKPYANQVECHVYKQHHPLIDYCESHNIFLMAHTTIGHPPLKGYRGCTLIEDPDVVSIANKIGKTPAQVCIKFLIQMSPKVIAIPMSLNPTNIKLNYDMNFILNDSQMSKLKSLDRFYAFKYYPDVFGVDVLGYGFNVWA

SEQ ID NO: 27030 - protein, 402 aa, Ginkgo biloba
MDAEDFGAAAAAAGFFRWDQRSTVFQKDNRPFELLLPPNARKELKSLEDLFREYGVRYSTMAKMNEMGFTANTLVNMTEEEIEDLMKALVEIYRMDLLIGERYGIKSAVRAEKKRLQDNLEMQRLELLSAETERKRMPDDHNTLVGITSEGTSKDLKTNDPMIFSENTSGNHAPMNMNGKDNPYIFVRQNNINKINNGHFCSSGLVGMPEHSSDSDERRIHTSKQKRRRPKEGAEDGEDRPREHPFIVTEPGELARGKKNGLDYLFDLYEQCGKFLSEVQRIAKERGEKCPTKVTNQVFRHAKHTGAVYINKPKMRHYVHCYALHCLDSEQSNHLRRIYKERGENVGAWRQACYYPLVAIARESNWDIEGVFNRNEKLRIWYVPTKLRQLCHMERSKHCNMQ

SEQ ID NO: 27031 - protein, 402 aa, Ginkgo biloba
MDPETFPAAFFKWDQRSSAAAAPIHRGLEGQRVFEFSVPTTTNPALTNNNNNNRKELSSLEELFRHYGVRYMTLTKMVEMGFTVNTLVNMTEQELDDVIRTLVDIYRVDLLVGEKYGIKSAVRAEKRRLDELERKKLDLFVDVDGKRKADENALDTLSQEGLSEEPQGDNAIILSQNTSGNIPLNLNGRDHVLLLQNNAGHLGGVNGLMGLPDNNYTNEQMKASKKQKRKRSKELGEDGEDRQREHPFIVTEPGELARGKKNGLDYLFDLYEQCGKFLLDVQHIAKERGEKCPTKVTNQVFRHAKHSGAGYINKPKMRHYVHCYALHCLDVDQSNRLRRLYKERGENVGAWRQACYYPLVVMAKENGWDIEGVFNQHEKLRIWYVPTKLRQLCHSEKSQEPH

SEQ ID NO: 27032 - protein, 425 aa, Juncus effusus
MDPAGDAFKWDPRAASAVNSAGAMSAAPPLAPPLPPVIQYDRPRELDELIEGFGVRYATIVRIGELGFTSSTLIGMTDGELDEMIATLAHVFRWDLMLGERYGLKTAIRAERGRLEGLRLIRMHHHHQLLGNETFHQFGFMHQNPSVNAIDALSQEVLSEEPMQEAAGSGGETRSKAGHPYHTKTNNKRRASSRNKKQRNRLEEDDDDQEDLDQDDRGWESESSETERNGGTERQREHPFIVTVPGEVARAKKNGLDYLFHLYEQCRMFLGQVQALARQQGHKCPTKVTNQVFRYARKTGASHINKPKMRHYVHCYALHCLDEELSNALRKDFKERKENVGAWRQACYEPLVNISARHGWDIDAVFNSHPRLAIWYVPTKLRQLCHIARNDAASSGGVGVGVNSTIVSMLGAVSNDVVPQPSPIF

SEQ ID NO: 27033 - protein, 387 aa, Botrychium dissectum
MDQENLPVALLRWDPRVVSHKDVQPLDVGFVPTNRKQMKSLEELFKDYGVRITTIAKVVEMGFTVSTLVNMTEQEIDDVIKTILDGYHIELLVGERYGFKSAIRAEKRRHEEEVERQRLQLLSRSGRKRKDDTAVVATSLEGIPREQGADNGLMFPDAIATIGPLNLNSKEPVLLEQSHTHFGAPALLAIPEPSSDNEKRKLGRKKQKRRHSREPGEDGDDRPREHPFIVTEPGELARGKKNGLDYLFDLYEQCARFLGEVQQISKERGEKCPTKVTNQVFRHAKLKGASYINKPKMRHYVHCYALHCLDLEQSNHLRKLYKDRGENVGAWRQACYYPLVEMARQNGWDIEGVFNRNEKLRIWYVPTKLRQLCHIEKSKDSDSCSYE

SEQ ID NO: 27034 - protein, 382 aa, Trochodendron aralioides
MDPDPFSASLFKWDPRSGAPPSNRLLEAMAPSPAYAIRPRELGGLEDFFQAYGIRYYTAAKIAELGFTVSTLLDMKDEELDEMMTSLSQIFRWDLLVGERYGIKAAVRAERRRIEDEESRRRYLLSSDTTNALDALSQEGLSEEPVQQEKEAAGSGGGGGVGTWEVVATEKKKQRRKKAVTKSVEDEEEEGGDDESGGGGERQREHPFIVTEPGEVARGKKNGLDYLFHLYEQCRDFLIQVQNISKERGEKCPTKVTNQVFRYAKKAGASYINKPKMRHYVHCYALHCLDEEVSNTLRRAFKERGENVGTWRQACYKPLVAIAALQGWDIDAIFNAHPRLSIWYVPTKLRQLCHAERSNNAASSSSAAAAAAAAGPIAGPPF

SEQ ID NO: 27035 - protein, 113 aa, Streptococcus thermophilus
MKKIEAIIRSDKLEDLKNTLTGSGLTKGMTVSQVLGHGTQRGFAEFVRGQRIVPTLLAKVKVEIVVKDLAVDEVVDTIRSAVATGEVGDGKIFIVPIDDVIRIRTGERGGDAI

SEQ ID NO: 27036 - protein, 175 aa, Capsicum annuum
MGRGKVELKRIDNKINRQVTFAKRRNGLLKKAYELSVLCDAEIALIIFSSRGKLYEFCSSSSMSKTLERYHKHNYGALEGTQPSADSQNNYQEYLKLKTRVEVLQQSQRHMLGEDLGELNTKDLEQLERQLDSSLRQIRSTKTQHMFDQLAELHQKEQSLTEMNKSLKTKVSISP

SEQ ID NO: 27037 - protein, 406 aa, Zamia furfuracea
MDPESFPAAFFKWDQIRSSSSAPPMQQRVFEFGIPAAATATNTNANTANGRKELSSLEDLFRHYGVRYVTLTKMVEMGFTVNTLVNMTEQEVDDVIRALVEIYRTDLLVGEKYGIKSAVRAERKRLDEIERKRLELFNVDIDGKRRIDHENALDTLSQEGLSEEPQGDNAIILSQNTSASIPMSLNGCRDPVLILQNNPHQLGAVSGLVGLPDHNNIQDEQLKFSKKQKRKRSKESGEDGEDRQREHPFIVTEPGELARGKKNGLDYLFDLYEQCGKFLLDVQHMAKERGEKCPTKVTNQVFRHAKHSGAGYINKPKMRHYVHCYALHCLDIEQSNRLRRLYKERGENVGAWRQACYYPLVVMAKDNGWDIEGVFNKHEKLRIWYVPTKLRQLCHLERKEVRNASD

SEQ ID NO: 27038 - protein, 406 aa, Zamia furfuracea
MDAENFPAGLFRSWDQRAVFHKADNRSFDLVLPLNGRKELLKSLEDLFREYGVRYSTLTKMCEMGFTANTLVNMTEEEIEDLMKTLVEIYRMDLLIGERYGIKSAVRAEKKRLQENLEMQRLELLSEAERKRIHDDHTFNAHAITTEGVSSKELRTDDPLIFPGSSNADGPLKGNNSNTHIIAQNHNNNSKNGQLCQSGLLGMPEVHSSDSDERKLDANCKQKRRRSKEAREDGEDRPREHPFIVTEPGELARGKKNGLDYLFDLYEQCGKFLLDVQRIARERGEKCPTKVTNQVFRHAKHTGAVYINKPKMRHYVHCYALHCLDSEQSNHLRRMFKERGENVGAWRQACYYPLVAIARDANWDIEGVFNRNEKLRIWYVPTKLRQLCHLDRSKACGGAAQNIADM

SEQ ID NO: 27039 - protein, 389 aa, Matteuccia struthiopteris
MDPEQFPSSLFRWDQRVIPRKEVPSMEVPLLPAATNTKQLKLLEDLFKEYGVRSTTIIKIMEMGFTVSTLVNMMEQEIDDVIKTMMEGYHMELLVGEKYGLKSAIRAERKRQEEDMERQRLQLLAKNGKKHKSDDSGMVATSVEGTREQRGDNGMMFPDAVALNGPLNLNSKEHAQQEHSHAQFGPPGLLALPEPSSDNEGRKLARKKQKRRLSREPGEDGDDRTREHPFIVTEPGEVARGKKNGLDYLFDLYEQCARFLDEVQQMSRERGEKCPTKVTNQVFRHAKLKGASYINKPKMRHYVHCYALHCLDKEKSNLLRKLFKERGENVGAWRQACYYPLVDMARDNGWDIEGVFVRNEKLRIWYVPTKLRQLCHLEKSKDSDSCSYE

SEQ ID NO: 27040 - protein, 387 aa, Nymphaea odorata
MDPDAFSATLFKWDARAAPPSRLLIHDAPVSATVHVSAGGAPPLGPAAAAAIPPPYCRSKELGGLEDLFQNYGVRYYTLAKMAEMGFTASTLLNMKDEELDEMMATLVDVFHWDLLVGERFGIKAAVRAERRWLLDDDVSRRRHHLASADSTNPLDALSQEGLSEEPVQGEKEGGVGVNGGGGGGWEVVVEGKKGQRRRRGTRGINGEGGGEDGGDRQREHPFIVTEPGEVARGKKNGLDYLFHLYEECRGFLIQVQNIAKERGEKCPTKVTNQVFRYAKSMGASYINKPKMRHYVHCYALHCLDEASSDRLRRAFKERGENVGAWRQACYQPLVVMAAHHSWDIDAIFNANEKLCIWYVPTKLRQLCHQQRTAAAASMGTAHLRQM

SEQ ID NO: 27041 - protein, 373 aa, Platanus racemosa
MDPDVFAANLFKWDPRGAAPPRNRLLEAVAPPPTYAIRPRELGGLEDFFQAYGIRYYTAARMAELGFTVNTLLDMKDEELDEMMTSLSQIFRWDLLVGERYGIKAAVRAERRRLEEEESRRRHLLMADATNALDALSQEGLSEEPVQQEKEAAGSGGGMWEVAAGERKKQRRRKTPTKSADDDDDEAADDEKGGEGGERQREHPFIVTEPGEVARGKKNGLDYLFHLYEQCRDFLIQVQNIARERGEKCPTKVTNQVFRYAKRAGASYINKPKMRHYVHCYALHCLDEDASNALRRAFKEKGENVGAWRQACYKPLVAMAARQGWDIDAIFNAHHRLAIWYVPTKLRQLCHAERNNAGASSSTSGGAITGPSF

SEQ ID NO: 27042 - protein, 380 aa, Peperomia sp. HBG70537
MDPDAFSSFFKWDPRSVAATTAPTNHPPLPRLMPSDAVVPASFRARELEGLQDFFSGYGVRLFTAAKLAEMGFTVSTLMDMKDEEIDDVTATLAQVFRCDLLVGERYGIKCAVRAERRRLEEEEAARRRQIVPLVGDGCALDALSQEGLSEEPMQEAAASGGDGTYGPVAGNADKKKQRVRRRRKSVKSNCSGGGDQSNDEDGDGGGACELRSREHPFIVTEPGEVARGKKNGLDYLFHLFEQCRQYLIQVQNIAKDKGEKCPTKVTNQVFRYAKKVGASYINKPKMRHYVHCYALHCLDEETSNAMRRAYKERGENVGSWRQACYKPLVAMAAGQGWDIDALFNGDPRLRIWYVPTKLRQLCHAERGLASTPALLGLPF

SEQ ID NO: 27043 - protein, 145 aa, Echinostoma caproni
TEFKLAMQEFMIMPTGASSFAEAMKIGSEVYHHLKAVIKGKYGLDACNVGDEGGFAPNIQDNLEGLELLRTAIEKAGYTGKVKIAMDSAASEFYKEGKYDLDFKNPKSPASSWISSDAMADVYKKMMSTYPIVSIEDPFHQDQNS

SEQ ID NO: 27044 - protein, 520 aa, Lilium longiflorum
MSRHESRKLSDDYEVVDVLGKGGFSVVRRGISKSRGKNNDVAIKTLRRYGYTLPGAQRSQPGQRGLSPLGMPTLKQVSVSDALLTNEILVMRRIVEDVSPHPNVIHLHDVYEDANGVHLVLELCSGGELFDRIVAQDRYSESEAAEVVQQIASGLAALHKSTIIHRDLKPENCLFLNQEKRSTLKIMDFGLSSVEDFTDPIVALFGSIDYVSPEALSQRQVSSASDMWSLGVILYILLSGCPPFHAPSNREKQQRILAGDFSFEEHTWKTITSSAKDLISSLLSVDPYKRPTANDLLKHPWVIGDSAKQELIEPEVVSRLRSFNARRKLRAAAIASVLSSKVLLRTKKLKNLLGSHDMKSEELENLRAHFKRICANGDNATLPEFEEVLKAMKMNSLIPLAPRVFDLFDNNRDGTIDMREILCGLSNLRNSQGDDALQLCFQMYDADRSGCISKEELASMLRALPEDCVPADITEPGKLDEIFDQMDANSDGVVTFDEFKAAMQRDSSLQDVVLSSLRTI

SEQ ID NO: 27045 - protein, 380 aa, Oryza sativa (indica cultivar-group)
MGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLVRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDICEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 27046 - protein, 552 aa, Rattus norvegicus
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEVEARRLFQQILSAVDYCHRHMVVHRDLKPENVLLDAQMNAKIADFGLSNMMSDGEFLRTSCGSPNYAAPEVISGRLYAGPEVDIWSCGVILYALLCGTLPFDDEHVPTLFKKIRGGVFYIPEYLNRSIATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPTGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDDRSYLLDFKSIDDEVVEQRSGSSTPQRSCSAAGLHRPRSSVDSSTAENHSLSGSLTGSLTGSTLSSASPRLGSHTMDFFEMCASLITALAR

SEQ ID NO: 27047 - protein, 215 aa, Arabidopsis thaliana
EMKRIENATSRQVTFSKRRNGLLKKAFELSVLCDAEVALIIFSPRGKLYEFSSSSSIPKTVERYQKRIQDLGSNHKRNDNSQQSKDETYGLARKIEDLEISTRKMMGEGLDASSIEELQQLENQLDRSLMKIRAKKYQLLREETEKLKEKERNLIAENKMLMEKCEMQGRGIIGRISSSSTSSELDIDDNEMEVVTDLFIGPPETRHFKKFPPSN

SEQ ID NO: 27048 - protein, 294 aa, Pinus contorta
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVSGLEPAGIDILSKMLCLEPSRRITARSALEHEYFKDLGFVP

SEQ ID NO: 27049 - protein, 298 aa, Homo sapiens [sequence omitted]

SEQ ID NO: 27050 - protein, 107 aa, Pyrus pyrifolia
MKSYKRRQKEHDENVQKVVKRLKDRNPSKDGLVAQHRKPWIAVGMRNVDYKRARHFEVDLSAFRNVLEIDQERMIAESEPLVNMGQITRITVLESRPCRGAEFDDLT

SEQ ID NO: 27051 - protein, 156 aa, Pisum sativum
KNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 27052 - protein, 133 aa, Rattus norvegicus
CRSDDHAVSGSLFTPLPAVLGHEGAGIVESIGEGVTCVKPGDKVIPLFSPQCGKCRICKHPESNLCCQTKNLTQPKGALLDGTSRFSCRGKPIHHFISTSTFSQYTVVDDIAVAKIDTAAPLDKVCLIGCGFS

SEQ ID NO: 27053 - protein, 607 aa, Leishmania major
MSHPTARGAGEKAPLVRGNFSETHGDPYVEELGPGALVYTASLIRDDRTSRTSGTISTVDCDPTDDDADWDVEKAKLRNCRNAKQQQTQHTFHTTGGKPSSNELWRFRTRGCQDCWAALFFAALIVVVLLWGMEQVWQLQLTERDLAVIAGVAEGKGYADTHTVAAVAGGSVHGKVLHGVAALRAGVAALWAGVEGLEPPADAHNSDASSPSSYAGMIGAVVQALIWCATAATTTILVAYGGLLLIAVYPRQLIFIQSAVASMFSAASAGVALAQGAGLMAMVFAFLAFTPLLWIYLIHDRIPFTTTMLCATVSVLQRHRSLFVISLGSAIASWCFVLAAVVCVLPSVLRFLAGTASSADIAYPVILVFGIFWVQEVLTALVHVTVCGVVATWYFAGEGNMPSFPVQASFQRATTTSFGSVCLGSLINAIASFVRFLIDTVRTSSDGDNFWMCIMSCLVGCIEDLVRYFNQYAFVHVAVYGCGYVDAAKETWALVKQCAFSAIFNDLLTGQVIGILTFMSAVLVALLTALVTWNAAAVALMFFMSLIVSSIFYNPVSSCVTTIYVCFAEVPVGLQLSFPELYAALVDADAGYTQRREEASVYGTALV

SEQ ID NO: 27054 - protein, 251 aa, Betula pendula
MGRGRVELKRIENKINRQVTFAKRRNGLLKKAHELSVLCDAEVALIIFSNRGKLCEFCSSPSMLKTLERYQKCNFGAPEPNVSAREALELSSQQEYLKLKARYEALQRTQRNLMGEDLGPLSSKELELLERQLNMSLKQIRSIRTQCMLDQLTDLQRKEHMLNEANRTLKQRLVDGYHIDTVLQLDQSANDVGYGRQPAQTQDDCFFHPLCEPTLQIGYQHDHPMTVVTAGSGSVVTAGPSVNNYMSGWMP

SEQ ID NO: 27055 - protein, 242 aa, Betula pendula
MEFQNQSMSVSPQRKLGRGKIEIKRIENTTNRQVTFCKRRNGLLKKAYELSVLCDAEIALIVFSSRGRLYEYANNSSVKTTIERYKKACAESSNSGSVSEANTQFYQQEAAKLRGQIRSVQNSNRHLLGEALSELNFKELKNLEIKLEKGINKIRSKKNELLFAEIEYMQKREAELHNNNQILRAKIAENERNQQNLNVMPGGGNYELMQSQSYDSRTYFQVDALQPNHHYPRQDQIPLQLV

SEQ ID NO: 27056 - protein, 197 aa, Hordeum vulgare subsp. vulgare
ECFPGRTDVQCLHRWQKVLNPELIKGPWSKEEDDIIVEMVKKYGPKKWSTIAQALPGRIGKQCRERWHNHLNPGINKDAWTQEEEITLIHAHRMYGNKWAELTKFLPGKTDNSIKNHWNSSVKKKIGSYMSSGLLAQVSRLPLVEHHAHFSSSPAITQQNSEDSESNAVREVEDSSGCSQSSLGIVSSRKCRHASLG

SEQ ID NO: 27057 - protein, 523 aa, Arabidopsis thaliana
MLQGSFRLIRVGWFLLNFRSFVSSIFDARKVFSATSNMRQRNMMTGSDMEQNSQSFVPHPEPRIGTNYLYPDIPPVNTVPHLEAHSLQEPYDNNSMFYGPPQYHHQHASNLGSGMSTAPNFYVPYVNYEAPPSFLLSHGSNDAVVGVTSTEHERNAHFMDHGFKRKSSEVIPGNSQYPVAPCSFPQLNTSETAPFSFPHFGTYPQPLDQRSVRNRAGAATMDPLLSHGHNNFSQGNYAAHPFPPLGSIWYDQHCNGNRSDGSSSLWSQAPAVPYMHGNIATGSIESGNVCFPRYHETSSSRNPTPSVYQRNHYISHHPVPPPPIVYPHMPSASYAETLHPASYSHMGQVQSTGFRINQYPGEDFVPAAILRHRELPHFRAMPANENAFWEVGDFYNAVNYVDHHQDMRLDIEDMSYEELLALSDQIGTVKTGLSSEDVKELLKRRTSTRINLEEGPSTDLETDSCTICQENYKNEDKIATLDCMHKYHAECLKKWLVIKNVCPICKSEALVIEKKKKLRLSSR

SEQ ID NO: 27058 - protein, 1127 aa, Loligo pealei
MAGVETAVRQIELKWPNVPEQLIKGDKFLKWEEGSSSFTEILLRVDPKGYFLYWKIEGKEDSQLLDLAYLRDIRCAKYAKPPKDKKVKDAGTNFGSSNIPLQDKCVTICHGYNYIDLDWIHLVAENSSVAAKWAEEVFSYAYNLLSLNKNQLGEWEKLYFRLTTVEMEKNKIPVKSIQKCLSKDKDDRTRVAKAIEKIGWPSGKNDAIEIKAFDFDTFFKFYLSLLERSEIEGIFKELSQNKGNITTVMFRDFLNDMQRHPSLHKTLFPLYTDSQCDALINEYESAVNKKGKKKGQLTKEGLLYFLMCEENNLTPMHRLDLGANMKLSLAAYYINSSHNTYLTGHQLTGKSSVEIYRQVLLTGCRCLELDCWDGKDGEPIITHGFTMCTEVQFKDVVHAIAECAFKVSEYPVILSFENHCSVPQQKLLAQYCHEAFGELLLDNPIDGHPLKPGVPLPTPYDLRKKILIKNKKIHKGAGDDDELAGLTDEEKKKIEKEKKDAGTAAKEAEAAEEMSALVNYIQPVHFTTFEQAQKKDRHYEMSSMVETQALNKLKDNPEDFVDYNKKQLTRIYPKGTRVDSSNYVPQIYWNAGCQLVALNFQCFDVAMCVNLGVFEYNGCSGYLLKPEFMRKLDKRFDPFTESTVDGVVAGTIEIKIISAQFLSDKQISSYVEVEMYGLPTDTVRKKFKTKTVNNNGMDPYYNENAFVFKKVVLPDLAVVRIIVNEDGGKFIGHRLMPLDGIKPGYRHIPLRNESNRPLGLASVFAHIVAKDYVSDAFADFADALLNPIAYQSAQDARAAALCAFEDDPDAALNAAKPVKGKSPKAGKKAWAGAGKKVSQGNIAKSAFGGAKKAAAAGKAATPASPPPPPAAADSEFVQNSKMKEESAVALPKLDALKSNKAYAKIISKRDKEVDSIKKKNDKAQSNMKTKMKAEEKKMKDSHSKAEKKAEKSGKEQHDQLVKENQDKFNQLHKENIDKYLATCSEHFNAESEICKKYIDSLNDCLKGVITSTQEDLKKKLQTIHDKEVESMNKELNKKSKEEQKNLGKETKDKEELARKKRELSKKLIDGIVAERNKLKALKERQEKVLDKNVEELTKEYEKEKANAENKLKEDIDAKLKKVKEEWS

SEQ ID NO: 27059 - protein, 221 aa, Arabidopsis thaliana
MNHRRSSIVLLILSILSPVTLSIRYELLSGHTKCISEEIHANAMTIGKYSIINPHEDHPLPSSHKVTVRYNAMCLIFKVTSPQGTAYHESDGVESGQFSFVAVETGDYISCFSAVDHKPETTLIIDFDWRTGIHTKDWSNVAKKSQVETMEFEVKKLFETVNGIHDEMFYLRDREEEMHNLNIATNSKMAWLSFVSLAVCLSVAGLQFWHLKTFFQKKKLI

SEQ ID NO: 27060 - protein, 141 aa, Arabidopsis thaliana
MEGDVLSGFGDRHNMDGKLLQSFQKSFVDVQDILDQNRLLINEINQNHESKQPDNLGRNVGLIKELNNNIRRVASLYGDLSHSFARSVDASSEGESSGTLKSDGKANQKRFRSDISLFADVATSRSFPHNYTDPNWHSEIE

SEQ ID NO: 27061 - protein, 331 aa, Arabidopsis thaliana
MITFFLVFDKFSWHCILKILSSPHFVAAFICIMLDEKCLKRLLLRPQNKERVGSLFMTFKCVCFLILLADLAYGDAIFACLIFCSVKRQILWTYQSVKLYDETILLSLYICHLMICTIELIQSYHQELDDTIVRKLVDRCGLSKRVDHWLNLLWRLLKFPWVYQLMSYRITNAFSFWFVWTRCVFLEDGKVIASGRNRTNETRNATRHAEMEAIDQLVGQWQKDGLSPSQVAEKFSKCVLYVTCEPCIMCASALSFLGIKEVYYGCPNDKFGGCGSILSLHLGSEEAQRGKGYKCRGGIMAEEAVSLFKCFYEQGNPNGNSSPFNLYTSIP

SEQ ID NO: 27062 - protein, 375 aa, Arabidopsis thaliana
MAKMINKTLVLTYIYLLIYIILSSGVILYNKVIADSTLFWVLSPKYFNFPLPITLTMIHMGFSGFVAFLLIRVFKVVSPVKMTFEIYVTCVVPISAFFASSLWFGNTAYLHISVAFIQMLKALMPVATFLMAVVCGTDKARCDVFMNMVLVSVGVVVSSYGEINFNVIGTVYQVMGIFAEALRLVLTQVLLQKKGLTLNPVTSLYYIAPCSFVFLSLPWYVLEKPNIDVSQIQFNFWIFFSNALCALALNFSIFLVIGRTGAVTIRVAGVLKDWILIALSTVIFPESTITGLNITGYAIALCGVVMYNYIKIKDVKAIQPTTDSLPDRITKDWKEKNSSDGGSPRGLELNDEEAPLITSRLSHIGRTQLGNHTAV

SEQ ID NO: 27063 - protein, 329 aa, Arabidopsis thaliana
MAAQVEIEDQTSVTNLDNGEIFDSISDDADSSVSHAGSSFSSSSLILLGEGNPEHDVIKTCLLSGMGVVSSDTTIVTISKNSSERGITTRAKFLAFRIFTDAVARKHGGDANVKYGWYAGSRDEIQRIISYGFSNRDVGKFENDGGSHGIGIHLVPSKCSLLAESYFCRASATEQDEEGLRYLLLCRVILGKPEIIISGSKQSYPSSAEFDSGVDDLHNPRNYVIWSCNMNSCILPSYIVSFRSPRLRVSRGGFASRPSSPWVSFASLMSMLSTSMDPSRMNLIIRTYDDFRKRKIRRDQLVRKMREVAGDNLLAEIIKNHKNRNKVTN

SEQ ID NO: 27064 - protein, 734 aa, Arabidopsis thaliana
MNSVGVFRKEEIDGKSFLVYTLTQTDNPTSSGEALAMDSGGDDLPLQPLFFCPAARINFHKLRLKMHNHDDDDDAEDDDNGDDKEDGDDDNKGDDGDDDNEDDNEDDDNDDDDDDDDDDDDDDDDDDDDGDDDNEDGDCDDDDGDLLLPFDSTPHFPSTRSGDQQGESLLDCNHPDVCKLPVVPLFWCNNKERSTVGFECGACKMTTLCESYFACLQCQGKFHKECVESPPEIKHPSHPFHSLRLCSFQTRLTSGCCRKITFGMFYQCTTCNLSMHPVCAMRPVPLVVDHPKSHPHPLSFFPTQASTVCHICAKIKHLDPTYICIQCVFVIHKGCMGFPHTIRISRHPHRISFTSSLPSRTLSCGVCHQQVDNNYGAYSCNNCDGYFVHSKCAIHPKVWDGKELEGVPEEDDLIDDGEPFERISDGIIHHPFHSHHLRHEMSITYDESKYCQGCALPIYEGQFYSCMECDFILHDSCANAPRMKRYPLYPHPITLKFATVRNNSFTSQFRCAVCDRHGNGFFYEHHGEDKMFRLDLRCALITEPLVYQGHMHPLFLLWDDTESLISCQMCKKKSYYSQLFCLECEYSLCLRCVTFPYKVRYKHDSHFLTICDVKEASDELDWCDICEGKIEEEKEKEYNWDDRERELRFYKCNDCSTALHVDCLLGVDMYMKPITDYISVITLTSKGTKRKDLWIFLNNSLTRPICTTCLSRCPFPIFFKGHTKIFCSLYCSED

SEQ ID NO: 27065 - protein, 180 aa, Arabidopsis thaliana
MEHSSDLTVEAMMLDSKASDLDKEERPEVLSLIPPYEGKSVLELGAGIGRFTGELAQKAGEVIALDFIESAIQKNESVNGHYKNIKFMCADVTSPDLKIKDGSIDLIFSNWLLMYLSDKEVELMAERMIGWVKPGGYIFFRESCFHQSGDSKRKSNPTHYREPRFYTKVQSFDLTFIFLK

SEQ ID NO: 27066 - protein, 464 aa, Arabidopsis thaliana
MAKTALTPPASGSEVPRSGTPGDASGNKPQTDATGVSATDTASQKRGRGRPPKAKSDSSQIGAVSAKASTKPSGRPKRNVAQAVPSTSVAAAVKKRGRAKRSTVTAAVVTTATGEGSRKRGRPKKDDVAAATVPAETVVAPAKRRGRKPTVEVAAQPVRRTRKVFGFSMHEQKSTSVAPVAANVGDLKKRTALLQKKVKEAAAKLKQAVTAIDEVQKLADGILTSDDVDFSVLFSNLKTLAAFDFDFRLGFLADPPSSAIEKKMNMEVDTVTRKPRILLAASGSVASIKFSNLCHCFSEWAEVKAVASKSSLNFVDKPSLPQNVTLYTDEDEWSSWNKIGDPVLHIELRRWADVMIIAPLSANTLAKIAGGLCDNLLTCIVRAWDYSKPLFVAPAMNTLMWNNPFTERHLVLLDELGITLIPPIKKKLACGDYGNGAMAEPSLIYSTVRLFWESQARKQRDGTS

SEQ ID NO: 27067 - protein, 1294 aa, Arabidopsis thaliana
MVFKSKLFFSSKKSRSSSPSSSNSPRSVGSDSPIRSDKKKPKSNSKEETRSPNTKKHVSAKGKEASLEVHSSSPGKSNSSSSGSEAKKPITETPATSDVKEESPASVSPIMASSLGLNRIKTRSGPLPQESFFSFENDYAIPVLPCYKLSKLDTGKKEAGSSKVDIGPLRSSNPALLASGTGQFKVSPTISGPEGSAEVCTPENSYDLDDPKESDSPRYQALLRMTSAPRKRFPGDIKSFSHELNSKGVRPFPLWKPRRLNNLEVVFEATFSDILNLIRTKFDKAKEEVNSDLFAFGGDLLDIYDKNKESHPELLVTIEDLLVLAKTCAKTTSKEFWLQCEGIVQDLDDRRQELPPGVLKQLHTRMLFILTRCTRLLQFHKESWGQEEDAVQLRQSGVLHSADKRDPTGEVRDGKGSSTANALKVPSTKKAYSQEQRGLNWIEGFFVRPAPLSSPYNETSKDSESPANIDKMSSWKRLPSPASKGVQEAAVSKEQNDRKVEPPQVVKKLVAISDDMAVAKLPEVSSAKASQEHMSKNRHNISWGYWGHQSCISEESSIICRICEEEIPTTHVEDHSRICALADKYDQKGVGVDERLMAVAVTLEKITDNVIQKDSLAAVESPEGMKISNASLTEELDVLSPKLSDWSRRGSEDMLDCFPETDNSVFMDDMGCLPSMSCRTRFGPKSDQGMATSSAGSMTPRSPIPTPRPDPIELLLEGKGTFHDQDDFPQMSELADIARCAANAIPVDDQSIQLLLSCLEDLRVVIDRRKTILLSVEASIAQAENLLEKYLQLCELMDDEKGTIIDEDAPLEDDVVRSLRTSPVHLRDRISIDDFEVMKSISRGAFGHVILARKNTTGDLFAIKVLRKADMIRKNAVESILAERDILINARNPFVVSCSSFKHIKSSAEISYTNVRFFYSFTCSENLYLVMEYLNGGDFYSMLRKIGCLDEANARVYIAEVCRYYSCQVLALEYLHSEGVVHRDLKPDNLLIAHDGHVKLTDFGLSKVGLINNTDDLSGPVSSATSLLVEEKPKLPTLDHKRSAVGTPDYLAPEILLGTGHGATADWWSVGIILYEFLVGIPPFNADHPQQIFDNILNRNIQWPPVPEDMSHEARDLIDRLLTEDPHQRLGARGAAEYSDETNIMTQVKQHSFFKDIDWNTLAQQKAAFVPDSENAFDTSYFQSRYSWNYSGERCFPTNENEDSSEGDSLCGSSGRLSNHHDEGVDIPCGPAEFETSVSENYPFDNFSFKVFYHDFLPKIPCHPSIRYIIVLYSCRSSLACSFRIENLLQTLSV

SEQ ID NO: 27068 - protein, 237 aa, Nicotiana sylvestris
MYQPISTEFPVYHRTSSFSSLMPCLTDTWGDLPLKVDDSEDMVIYGLLSDALTTGWTPFNLTSTEIKAEPREEIEPATSPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTVKRRSPEPASSSISPASENSLPKRRRKAVAAKQAELEVQSRSNVMQVGCQMEQFPVGEQLLVS

SEQ ID NO: 27069 - protein, 227 aa, Nicotiana sylvestris
MAVKNKVSNGDLKGGNVKTNGVKEVHYRGVRKRPWGRYAAEIRDPGKKSRVWLGTFDTAEEAAKAYDTAAREFRGPKAKTNFPLPSENQSTSHSSTMESSSGETGIHAPPHAPLELDLTRRLGSVAADGGDNCRRSGEVGYPIFHQQPTVAVLPNGQPVLLFDSLWRPGVVNRPQPYHVMPMAMGFNGVNAGVDPTVSDSSSVVEENQYDGKRGIDLDLNLAPPTEF

SEQ ID NO: 27070 - protein, 282 aa, Nicotiana sylvestris
MASPQENSTTLDLIRQHLLDDNVFLEHYCSETETTTLIYSQSSSSSESLDQSFSFEPTLNYATTAQSSNLEVSTFFNNSKTEFDSFEFGTIPNVSAARSSSLKQTSFKERKPSLNIAIPVKQEVVQKVELAPTEKKHYRGVRQRPWGKFAAEIRDPNRKGTRVWLGTFDTAIEAAKAYDRAAYKLRGSKAIVNFPLEVANFKQEFNNEIRPLVNSSRKRVRETVNEEQLVINKEMKIEEERVPTAPLTPSSWSAIWDSGDGKGIFEVPPLSPFGAYSQLVMI

SEQ ID NO: 27071 - protein, 207 aa, Arabidopsis thaliana
MVRGKIEIKKIENVTSRQVTFSKRRSGLFKKAHELSVLCDAQVAAIVFSQSGRLHEYSSSQMEKIIDRYGKFSNAFYVAERPQVERYLQELKMEIDRMVKKIDLLEVHHRKLLGQGLDSCSVTELQEIDTQIEKSLRIVRSRKAELYADQLKKLKEKERELLNERKRLLEEVNMHHSSKGNTEGGHRTKHSSEVETDLFIGLPVTRL

SEQ ID NO: 27072 - protein, 497 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLRPVAKDVSYSGENTEAWYPPGHGDIYASFYNSGLLDTFIGEGKEYIFVSNIDNLGATVDLYILNHLINPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 27073 - protein, 162 aa, Plasmodium vivax
YFPTQAFNFAFKDYFKNVFPKYDQNTDFTKFFCVNILSGATAGAISLLIVYPLDFARTRLASDIGKGKDRQFTGLFDCLKKIYKQTVFLSLYSGFGVSVTGIIVYRGSYFGLYDSAKALLFNNDKNTNIVLKWAVAQSVTILAGLISYPFDTVRRRMMMMSG

SEQ ID NO: 27074 - protein, 472 aa, Escherichia coli
  unsure (1)..(472): unsure at all Xaa locations
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETXNVTLEHIERKLMAGEKLRNIGV

SEQ ID NO: 27075 - protein, 256 aa, Brassica oleracea
MGRGRVQLKRIENKINRQVTFSKRRAGLFKKAHEISVLCDAEVALVVFSHKGKLFEYSTDPCMEKILERYERYSYAERQLIAPESDVNTNWSMEYNRLKAKIELLERNQRHYLGEDLQAMSPKELQNLEQQLDTALKHIRSRKNQLMYESINELQRKEKAIQEQNSMLSKQIKERENVLRAQQEQWDEQNHGHNMPPPPPPQQHQIQHPYMLSHQPSPFLNMGGLYQEEDQMAMRRNDLDLSLEPVYNCNLGSFAA

SEQ ID NO: 27076 - protein, 765 aa, Plasmodium falciparum
MPSSSVYCKNKQICIIKASLKNCSLKKSGVNISIPLPNNSYKKNKIVNNIYNGKDKKKENKIHQDKYVEYEKVGYENIKEYIKSNSYKAIHLCKNNKVNMKSCFSYSNNTGDVNTIGKKDSYKKNINLTMSSNNQIKYDHIKNYNIERYKNNIIKRKSEPIGKTKLFIYNKLNEKNMYKYNHKDDHNIYHKMKERNKYNINEKGMSKIFNTHKIGKKMCKNVCSKKNLCNIQKNVFIKNDNAIKYNNIYNNIYNNTKDKKEKNNGELIKSKTTMLNTPIRKCKIRHIIVSASFINKKNIKELNKIMLNNKHKSKLNNKENNIINVKENIHLNDLSSNIYEEHKHNYDIHKDNKNSSMDYTNEMWIKENEYLEENKKNKYKIIVVKNKKKEIGNYIVTKKKIGKGTFGKVCLGIHIYTHEIVAIKILNKKRLIEIINYDKIIKEIEIHKNINHNHICKFYDVYQNKNNIYMILEYVENGNLLTYIYNNYNINENNARRILYQLINAIEYLHEIKIVHRDLKPENILLDNNNNVKLIDFGLSTIYRKNCLLTTSCGSPFYTSPEILLGQKYEAELTDVWSLGIILFLLLNHRLPFNNSDMNKLFTQIIKGILYFQPYVSKNAKHLLQNMLNVNFKKRFTMNKIKNHIWFTTHPMKIMLSNNISTTCNLIDCNTCWYKYIIYKKNNSYYNDMIINKISKMYNINKRYINKQLINKHKNYVKTAYDLLINKIIRNLANHGDIYSRHLIITRNGHNNIQERIFHYKTDGL

SEQ ID NO: 27077 - protein, 220 aa, Rumex acetosa
MARGKIQIKRIENDTNRQVTYSKRRSGLFKKAKELTILCDAKVSIIMISNTNKLHEFISPNITTKQVYDAYQTTFSPDLWTSHYAKMEQELRNLNEVNRQIRKEIRRRMGCCLEDMSYQELVFLQQDMENAVTNLSERKYKVLSNQIETGKKKLRNVQGIRQNLMQAYDALREDPHCGLVYNGGEYDHVMRSHLVGLHFPREAHIPSAGGSCLTTYTYLE

SEQ ID NO: 27078 - protein, 195 aa, Rumex acetosa
MTRGQIQIRRIENITNRQVTYSKRRNGLFKKAQELVVLCDAKVSIIMISSRNKLHEFTTPGTTTKQIYDMYQQLSGNDVWSSQYAMMLEELRKIKEANGNIRKEIRRRMGFSMEDMSFRELVILQQDMQDSVAKISERKYKAIANQIETTRKKLRNSHGIHRSLVHAFGALNLNEYGADPPTAAGSYLTTYTYLE

SEQ ID NO: 27079 - protein, 506 aa, Arabidopsis thaliana
MFAYRFLFVLVRMVAIPNIKIKFGPQGSVRTFQTLSDSSKKIEHVVTEDLSQSSEKSKKRGGPKELDEVQPKKKQRLDCDWSSQCLALLRFLMEHRGGWLFKEPVDPVKMEIPDYFNVIQKPMDLGTVKSKLLKNVYSNADEFAADVRLTFANAMHYNPLWNEVHTIAKEINEIFEVRWESLMKKKVLRLSWNEVREGYKRQPVERDCSRRSSTGTSASSGVGLTKPAKENSEKGSLSSKPVKVQSKKNTPAVTPKALATCKCGRIICICLKSCSSFGSDVCSLTDCQLKNISGAQASELDPQSNGSDTSKKERNGSLKSQLDKPSNSDLLGNELKTAFPALPPVPPEKALRAAILKAQYAGTIIKAKHRIVLGQNNKADLIRIQIEKEQMERAQREEKARIEAEMRAAKVAERMRAQDELKQKRESQRLEIAKMKKGFDFERNNHSKLKKKFVKVCGCFSLTKARLLLEELGLVLKNDYCPELEVIGSEKFDAMRMDDLEEGEIL

SEQ ID NO: 27080 - protein, 313 aa, Xenopus laevis
MSRPSSAGPCASKPCGKQKQPPPPPPHAPSLPATISGGPGASAPPAPTAAAITGPLSQQHQELTSLFECPVCFDYVLPPILQCQAGHLVCNQCRQKLSCCPTCRASLTPSIRNLAMEKVASAVLFPCKYASTGCSLSLHHTEKPEHEDICEYRPYSCPCPGASCKWQGSLENVMQHLTHSHKSITTLQGEDIVFLATDINLPGAVDWVMMQYCFNHHFMLVLEKQEKYEGHQQFFAIVLLIGTRKQAENYAYRLELNGNRRRLTWEATPRSIHDGVAAAIMNSDCLVFDTAIAHLFADNGNLGINVTISTCCP

SEQ ID NO: 27081 - protein, 816 aa, Trypanosoma cruzi
MGDMKRFIVAVAAVCLLAATVSAAPAGGEGEKLLLKKDIDAHRLSQKEGVGNNPLAKDGGNTKERTPPLMSADVTTVIIVTSAALGFSFAMYWWYVVSEIRITPGKDQGMRNAYLTDEVMRNVYVISRRVSEGANAFLYAEYRYMGLFMIAFGTLIFFLLGVAYSSPQEGSRPVASPWANAALSLLAFFVGSLTSVFAGWIGMRIAVYTNARTAVMATEGSEEGDQSLGFAKAFQTAFRGGITMGFALTSAGLFSLFVPVKVIGAYFDDAPENVLNVYECVAAFGLRVGTAVACFARVGGGIYTKAADVGADLVGKVERNIPEDDARNPGVIADCIGDNVGDIAGMGSDLFGSFGQTSCAELVIAAGSAELSSEFTYMMYPLLITAVGILVCIGSALIVANNSGVQRAEDVEPTLKRQLLFSTVAATVALVFLTDFGLPDTFTVGTTATTKWRALVCVMCGLWSGLIIGYTTEYYTSNAYHPVQEIAEACETGAATNIIYGLSLGYFSVVPPILAMAVTILSASYRMADLYGFALAALGILSTMSIALTIDAYGPISDNAGGIAEMAHMGHEIREITDALDAAGNTTAAIGKGFAIASAAFVALALYAAYVSRVGIPTINILDARVMSGLLVGAMLPYCFSAFTMKSVGLAAMDMVNEIRRQFQNPAIAEGTEEPDYESCVAIATQAALQQMVAPACLVMLTPIVVGVLFGRYTLAGLLPGAIVSGVQVAISASNTGGAWDNAKKYIEKGGLRDKNKGKGSPQHAAAVIGDTVGDPLKDTSGPALNILIKLMAIISVVFAPVFESQLGGIIMRYIE

SEQ ID NO: 27082 - protein, 517 aa, Taeniopygia guttata
MTSSKIEMPGEVKADPAALMASLHLLPSPTLNLEIKYTKIFINNEWQNSESGRIFPVYNPATGEQICDIQEADKVDTDKAVRAARLAFSLGSVWRRMDASERGHLLDKLADLVERDRAILATMESLNSGKPFLQAFYVDLQGVIKTLRYYAGWADKIHGMTIPVDGDYFTFTRHEPIGVCGQIIPWNFPLLMFAWKIAPALCCGNTVVIKPAEQTPLSALYMGALIKEAGFPPGVVNILPGFGPIVGAAIASHVGIDKIAFTGSTEVGKLIQEAAGRSNLKRVTLELGGKSPNIIFADADLDYAVEQAHQGVFFNQGQCCTAGSRIYVEESIYEEFVRKSVKRAKRKIVGSPFDPTTEQGPQIDKKQYNKILELIQSGITEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGSKSGNGREMGECGLREYSEVKTVTIKIPQENS

SEQ ID NO: 27083 - protein, 1179 aa, Aedes aegypti
MVAHSLQQEVNLSRRACRIPKWPLSGAQQEEENDEEVLEEQLLNGANQSPASEVAAFRLGPVHSENSPGGIDEDPLSFRNRRMHDGRMGSVVDFSCDLVAHVFLLVKALVMGVLRFDLTSPKRASSSSSSSSSYGSQFSKNLVKWCTWAIVLSVLLANHGGFVLARPKNGVVTADGVDAASVASGQWELLTPQPVSSDGAGGGQISGSLSSVKQQDDQSHGGELGDASHGEGHEVERYPVAQVEFSRVETPFVIGVWILSASIAKIGFHMTPKLSKIFPESCLLIVVGVIIGVLLRYATNLHVSPLTPNTFFFYMLPPIILDAGYFMPNRMFFDNIGTILLMAVIGTIFNIATIGVSLWACGLTGIFGVDLPFLHVFLFSSLISAVDPVAVLAVFEEIHVNEVLYIVVFGESLLNDAVTVVMYHMFESYNEIGASNIQVVDIVSGVASFFVVALGGTIIGVIWGFLTGLVTRFTDHVRVIEPIFIFVMAYLAYLNAEIFHMSGILAITFCGITMKNYVEQNVSHKSHTTIKYALKMLSSSAETIIFMFLGVATVNNRHIWNTWFVILTIVFCSVFRIIGVLILSAMANRFRIHKLSKVDQFVMSYGGLRGAVAFALVLLVSTDHIPLQPMFVTTTIAVIYFTVFLQGITIKPLVRVLNVKRANKRKPTMNERIHERFMDHTMAGIEDIVGKTGNYNIRDKFKRFDNRFIRPYLIKNLQGPEPKILETYSKLTMRDAMDYMRRNPSTIGQMSGTESMSALFRNYTGVFGGSPSFSNLENSTRNLDMQELDYNPSKKDLTDARIHHLLSVELKPYRRTRRLSYSRHAVDDRDLSTQVNYKMQMNIRRMISEKKHKRSKRGKDGKTQNHVSFPELPQNGSAKQFANDYINEVLHEDNEDEDKLPTAAGDDWDGGGLTFTAKSSLDEKSEQPKNDKRMSKDLRDLEAAENRVTTPTAIEAVLPWKRVDEDDENGAIKQNEFPSWASNKEYLAYNSPSATFLGGLTQPKQAKSVIGLFRRESSGSGGIVIGGVTDSETSTPVTATTPIGRAKKDKRSASIAGYITFPGSSDAGDDPLGVSRAVVSHANAFPVTASHRRNNRRGSLLELSGEAIPEENYSKSLPDRDKHGPRRGPTLIKASGTPKPARNSKSNNPQTTALLSSSSTDSEEEEEEDEDCADEQHPI

SEQ ID NO: 27084 - protein, 349 aa, Citrullus lanatus
MADQELPPPSQLVPLDFNSIQTVPESHLWPNSIELSPAIKLDERISLPIIDFLDDGASELLGRACEQWGMFQLINHGVPKTLIDEAEEETRRLFSLPARQKMKTLRTDSLTATGYGMAGISKYHQKLMWHEGFTMSGSPVDDAKKLWPNDYKRFCDVMEEYQSQMKGLGERIIRLIFKFLDISEEEMMKLLTSTDESAGKPYMALRLNSYPPCPDPSRVMGLAAHTDTSLFTIVHQARHDGLQVFKDGTGWVPLSPMSGTLIVNVGDILHILSNGRFPSILHRVMIHENKEHRFSLAYFYDPPGDLYISPYCKPLSESPQIPLYRCVNVKEYFTIKAKKEGKGLSAIKI

SEQ ID NO: 27085 - protein, 274 aa, Streptomyces griseus subsp. griseus
MTSGFAPTLLQGRTTFLTGASSGIGAVLATMLAAHGSSVALMARSEKELRLLAERIEADGGRAVAVPGDLTDGDSVRAAVREAEEQLGPIDRLVHCAGEARNQAFLCDQDEEQWTATLDINLLGAFRVARAVVPGMMERREGNIVMVSSIAGKRGLPANTSYCASKFGLNGMTQALASELGSFGVRVNAVCPGLTDSPAATDGGRYGDAFMAAIAKHHGPPDLTWERYLRRAVNSTILRRLVRPEEIAAQVLFLLSDLSGGMTGQAVNVDAGAL

SEQ ID NO: 27086 - protein, 431 aa, Euglena gracilis
MPVIKTVKARQILDSRGNPTVEVDVILDNGLLGRGAVPSGASTGEYEAVELRDGDKAVYLGKGVLKSVEAVNTIVAPKLVGLDPTEQLKIDNLMRELDGTPNKGKIGANGILGVSMAVCRAAALVKGVPLYRHIGDLHGNKTFQMPVPMCNIINGGKHADNKIDFQEFMVMPVGAANFSEGLRWCAEIFHHLKSILKKAGHVTSVGDEGGFAPNLDNDEALDFVIAAIKAAGFEPGKQIAIALDCASSELFDEGDRKGYKYWKSNPDRLFSAAEMIEKYAGWVAKYPIVSIEDPLDQNDWDGYVNMTKQLGGKIQIVGDDFFVTNPTRFKKGIELAACNSILIKVNQIGTVSETLECIKMAQAAGYTAVASHRSGETEDAFIADLAVGTAAGQIKTGSLSRTDRMAKYNQLIRIEEELGGEAKWTTAMLRK

SEQ ID NO: 27087 - protein, 485 aa, Euglena gracilis
FFSILPIMANNTADIQYLRQHNIPELVNDLIQQLVTTKPAQPVAFLRDVLSKRKAVIKVVKARQILDSRGNPTVEVDVILDNGVVGRGAVPSGASTGEYEAVELRDGDKKVYLGKGVLKSVNAVNTLVAPKLIGLDPANQREIDELMKQIDGTPNKGKIGANGILGVSMACCRAAALTQGIPLWKHIANLHGNKDNFQLPVPMCNIINGGKHADNKIDFQEFMIMPIGAKSFSEGLRWVTEIFHTLKALLKKAGHVTSVGDEGGFAPDLSNDEALEFVMKAIKAAGYTPGTQIGVALDCASSELFDEGGRKGYKFWKSNPSKLFSAQEMIDIFCRWCDEYPIVSIEDPLDQNDWDGYVNMTKKMGRRTQIVGDDFFVTNPARFSKGIGMNACNAILIKVNQIGTVSETLECIKMAQAHGYGSIASHRSGETEDAFIADLAVGTGCGQIKTGSLSRTDRMAKYNQLIRIEEELGAQAKWTTKHLVR

SEQ ID NO: 27088 - protein, 444 aa, Spinacia oleracea
MVTIKSVKARQIFDSRGNPTVEADIHLDDGTFARAAVPSGASTGIYEALELRDGGKDYMGKGVFKAVQNVNEIIGPALVGKDPTEQTAIDNFMVQELDGTTNEWGWCKQKLGANAILAVSLAVCKAGAQVKKIPLYQHIAEISGNKKMVLPVPAFNVINGGSHAGNKLAMQEFMILPTGASSFREAMKMGSEVYHHLKSVIKKKYGQDATNVGDEGGFAPNIQENKEGLELLKTAIEKAGYTGKVVIGMDVAAAEFYSKDKTYDLNFKEENNDGSQKISGDALKDLYKSFVSEYPIVSIEDPFDQDDWEHYGKLTAEIGDKVQIVGDDLLVTNPKRVEKAINGKSCNALLLKVNQIGSVTESIEAVKMSKRAGWGVMASHRSGETEDTFIADLSVGLSTGQIKTGAPCRSERLAKYNQLLRIEEELGDKAIYAGADFRAPVEPY

SEQ ID NO: 27089 - protein, 383 aa, Citrus sinensis x Poncirus trifoliata
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 27090 - protein, 315 aa, Capsella rubella
MGTVLKLPIIDLSSPEKISTSRLIRQACLDHGFFYLTNHGVSEELMEGVLMESKKLFSLPLDEKMVMARRGFRGYSPLYDEKLDPSATSKGDSKEIFTFGSSEGVLAQIYPNEWPLEELLPLWRPTMECYYKSVMDVGKKLLGLVALALDLEEKFFEQVEGFNVQAAVVRLLRYPGELNSSGEVTCGASAHSDYGMLTLLATDGVPGLQVCRDKDKEPRVWEDVAGIKGAFLVNIGDLMERWTNGLFRSTMHRVVSVGKERYSVAVFFDPDPNSVVECLESCCSETSPPRFPPIRTRDYFHERFSQTFASYSGSG

SEQ ID NO: 27091 - protein, 289 aa, Capsella rubella
MMLEKDDLGLSLGLNYPKKQMNLNSNPSVSVTPSSSSFGLLRRSSLNESFTSSVPNSDSSQKETRTFIRGIDVNRPPSTAEYGEEDAGVSSPNSTVSSSTGKRSEREEDTDPQGSRGGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSAPPPQQPPQAATSAQHHRGSLPVNAWAQGTRISHGLTFDALRPRS

SEQ ID NO: 27092 - protein, 163 aa, Homo sapiens
IIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 27093 - protein, 354 aa, Homo sapiens
MPLLGQTVRSASARTRRWSRRAAGDRPGASSEARRPQLRGDHGIVVDRVRGHWRIAAGSCSTCWCPSALCSSTNGFMCTTGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCIALFGGYVLFKDPLSINQALDILCTLFGILAYTHFKLSEQEGSRSKLAQRP

SEQ ID NO: 27094 - protein, 316 aa, Homo sapiens
MIADRVRTDAYRLGILRNWAALRGKTVLDVGAGTGILSIFCAQAGARRVYAVEASAIWQQAREVVRFNGLEDRVHVLPGPVETVELPEQVDAIVSEWMGYGLLHESMLSSVLHARTKWLKEGGLLLPASAELFIAPISDQMLEWRLGFWSQVKQHYGVDMSCLEGFATRCLMGHSEIVVQGLSGEDVLARPQRFAQLELSRAGLEQELEAGVGGRFRCSCYGSAPMHGFAIWFQVTFPGGESEKPLVLSTSPFHPATHWKQALLYLNEPVQVEQDTDVSGEITLLPSRDNPRRLRVLLRYKVGDQEEKTKDFAMED

SEQ ID NO: 27095 - protein, 311 aa, Homo sapiens
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 27096 - protein, 261 aa, Homo sapiens
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 27097 - protein, 795 aa, Homo sapiens
MSARTPLPTVNERDTVNHTTVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRDPSEGEASGRTDTSRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 27098 - protein, 375 aa, Capsicum annuum
MVDANMGAAGGQFPEFPNIVTHGGQYVQYDIFGNFFEITTKYRPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVIHRDLKPSNLLLNANCDLKICDFGLARPNLENENMTEYVVTRWYRAPELLLNSSDYTEAIDVWSVGCIFMELMNRKPLFAGKDHVHQIRLLTELLGTPTESDLSFLRNEDAKRYIRQLPQHPRQQLAKVFPHVNSLAIELVDKMLTLNPTGRITVEEALAHPYLAKLHDAADEPVCPVPFSFDFEQQGIGEEQIKDMIYQEALVLNPEYA

SEQ ID NO: 27099 - protein, 394 aa, Capsicum annuum
MDGPAQQTDTVMAEAAAAQQPAPPSQPVAGIDNIPATLSHGGRFIQYNIFGNVFEVTAKYKPPIMPIGKGAYGIVCSALNSETNEHVATKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPRNLLLNANCDLKICDFGLARVTSETDFMTEYVVTRWYRPPELLLNSSDYTAAIDVWSVGCIFMELMDRKPLFPGRDHVQQLRLLMELIGTPSEAEMEFLNENAKRYIRQLPLYRRQSFVEKFPHVNPAAIDLVEKMLTFDPRRRLTVEDALAHPYLTSLHDISDEPVCTTPFSFDFEQHALTEEQMKELIYREGLAFNPEYQHM

SEQ ID NO: 27100 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYCHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 27101 - protein, 266 aa, Streptomyces maritimus
MPAHTESPSVALVTGGTSGIGLSIAQALLQDGLKVIITGRDPGKLETVVRSLKMEDDQFDVAGYTCDVRDRDAVHDMVERCAKEHGEPKVLVNNAGRSGGGVTAAIPDELWLDVINTNLNSVFWVTREVIRSSDAIKQPAGRIINIASTGGKQGVPYGAPYSAAKAGVIGFTKALAKEFAAHGGPTVNAVCPGYVETPMAQDIRASYAKLNNVTEEQVLADFEAKIPLGRYCTPEEVAGMVRYLVSPAAASVTAQALNVCGGLGSY

SEQ ID NO: 27102 - protein, 506 aa, Rhodospirillum rubrum
MLYAAPGTADAIFAFKPRYDNFIDGTWQPPVRGEYFDNVTPITGKVFCKAARSTEEDITLALDAAHAAADRWGRTTAAERALILNRIADRLQDNLETLAYVESIDNGKPIRETLAADIPLAIDHFRYFAACIRAQEGSLSQIDETTIAYHFNEPLGVVGQIIPWKFPILMATWKLAPALAAGNCIVLKPAEQTPISILVLTELIADLLPPGVLNVVNGFGLEAGKPLASSKRIAKIAFTGETATARLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 27103 - protein, 709 aa, Bos taurus
SNSWLQEDCTIWQEEESQLFSIEDIQEVRMGHRTEGLEKFARDVPENRCFSIVFKDQRNTLDLIAPSPADAQHWVQGLGKIIHHSGSMDQQQKLRHWIHSCLRKADKNKDNKMSFKELQNFLKELNIQVDDSYARKIFKECDHSQTDSLEDEEIETFYKILTQRKEIDRTFEEATGSKETLSVDQLVTFLQHQQREEEAGPALALSLIERYEPSETAKAQRQMTKDGFLMYLLSADGSAFDLADRRVYQDMDQPLSHYLVSSSHNTYLLEDQLTGPSSTEAYIRALCKGCRCLELDCWDGPNQEPIIYHGYTFTSKILFCDVVRAIRDYAFKASPYPVILSLENHCSLEQQRVMARHLRTLLGPMLLDRPLDGVVTSLPSPEQLRGKILLKGKKLGGLFPPGGENGPEATVVSDEDEAAEMEDEAVRSQVQHKSKEDKLRLAKELSDMVIYCKSVHFRGFPSSGTSGQAFYEMSSFSENRALRLLQESGNSFVRHNVNHLSRIYPAGWRTDSSNYSPVEMWNGGCQIVALNFQTPGSEMDVYQGRFLDNGACGYVLKPAFLRDPNSTFNSRALAHGPWWTPKRLNVRVISGQQLPKVNKNKNSIVDPKVTVEIHGVTGDVASRQTAVVTNNGFNPWWDTELEFEVAVPELALVRFVVEDYDASSKNDFIGQSTIPLKSLKQGYRHIHLLSKNGDQHPSATLFVKVALQD

SEQ ID NO: 27104 - protein, 336 aa, Klebsiella aerogenes
MKRELAIEFSRVTEAAALAGYKWLGRGDKNTADGAAVNAMRIMLNLVNIDGTIVIGEGEIDEAPMLYIGEKVGTGKGDAVDIAVDPIEGTRMTAMGQANALAVMAVGDKGCFLNAPDMYMEKLIVGPGAKGAIDLNLPLEENLHNIARALNKPLGELTVTVLAKPRHDAVIAQLQQLGVRVFAIPDGDVAASILTCMPDSEVDVLYGIGGAPEGVVSAAVIRALDGDMQGRLLARHHVKGDNEENRRIGENELARCKTMGIEAGKVLRLDEMARSDNVVFSATGITKGDLLDGITRKGNMATTETLLIRGKSRTIRRIQSIHYLDRKDPDIQQHIL

SEQ ID NO: 27105 - protein, 186 aa, Bos taurus
PVDLSKWSGPLSLQEVDERPQHPLQVKYGGAEVDELGKVLTPTQVKNRPTSITWDGLDPGKLYTLVLTDPDAPSRKDPKYREWHHFLVVNMKGNNISSGTVLSDYVGSGPPKGTGLHRYVWLVYEQEGPLKCDEPILSNRSGDHRGKFKVASFRKKYELGAPVAGTCYQAEWDDYVPKLYEQLSGK

SEQ ID NO: 27106 - protein, 209 aa, Bos taurus
SEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKT

SEQ ID NO: 27107 - protein, 754 aa, Synechococcus elongatus
MLAPSSNCSLASQRLTPEGFAQLQSALQDFVATLPQAFYWDSRSLHTHLRTQTGDCAIAIAAGFQLLLLGRTAAEYCQPHPLSEPHHVSVQFGADSIQRYCQATNLPVEYQPALAQLGDLSLNPDLISQFSNLLIAAIAADRAPLAAQYPAVSVCQPLEQALHWQEEQDRLISQVSAQIRLSLDLSEILTTTIREIRQLLNADRAIIYQFKPQCLDAGLDQRWPLYIPSQSYITYEDRRNEALLSVIDPLVQPGLLITTEEWQRFQQGETLLIDSVGFYKERLPEQYSFYERVQVRSVCKIPILVQGRIWGLLVAHQCQQDHRWQPRERDILQHLAEHLSIAIYQAQLYGQLQDQTQTLENRVLERTQELIDALALAQAANAAKGEFLATMSHELRTPLTCVIGMSSTLLRWAFGPLTERQREYIKAIHDSGEHLLELINDILDLSQIEAGKAALQVRPFSLSRLATQTLNTLQEKARLGEIQLMLDLQLNNRVDVFRADPKRLRQILINLLSNAVKFTEPQGTVFLRVWREGDRAIFQVSDTGIGIPESEQAQLFQKFQQLDTSIRRQYGGTGLGLALTKQLVELHGGHIQIESTVGQGSTFTVWIPEQTLIEPVEPRPSIDNLPAGHILLLEEEDEAATVVCEMLTAAGFKVIWLVDGSTALDQLDLLQPIVILMAWPPPDQSCLLLLQHLREHQADPHPPLVLFLGEPPVDPLLTAQASAILSKPLDPQLLLTTLQGLCPPNLSEGDRPSS

SEQ ID NO: 27108 - protein, 312 aa, Arabidopsis thaliana
DDESGFRYMNYFRYPDRSSFNGTQTKTLHTRPLLEDLDRDAEVDDVWAKIREEAKSDIAKEPIVSAYYHASIVSQRSLEAALANTLSVKLSNLNLPSNTLFDLFSGVLQGNPDIVESVKLDLLAVKERDPACISYVHCFLHFKGFLACQAHRIAHELWTQDRKILALLIQNRVSEAFAVDFHPGAKIGTGILLDHATAIVIGETAVVGNNVSILHNVTLGGTGKQCGDRHPKIGDGVLIGAGTCILGNITIGEGAKIGAGSVVLKDVPPRTTAVGNPARLLGGKDNPKTHDKIPGLTMDQTSHISEWSDYVI

SEQ ID NO: 27109 - protein, 256 aa, Misgurnus anguillicaudatus
KGKPPDEEPIITHGFTMTTEILFKDVIEAIAESAFKTSKYPVVLSFENHVDTVKQQEKMAQHCRTIFGDKLLIDLLDKYPLKVGQQIPSPSELMCKILIKNKKSSTPANKQDNAKKPQEATPGEGSETPAADPNSPETHEEQIEEHDDHDEQDEEKMKNSDEGTAGQEVTAFEEMSALVNYVQPNKFISFENAAKKNKSFVISSFVETKGESLIAKNAVDWVEYNKRQMSRIYPKGTRVDSSNYMPQPFWTAGCQF

SEQ ID NO: 27110 - protein, 283 aa, Misgurnus anguillicaudatus
KGKTSEEEPIITHGFTMTTEIPFKEVIEAIAESAFKTSQYPLILSFENHVDSAKQQAKMAEYCRSMFGDALLTEPLEKYPLVPGQQLPTPQDLMGKILIKNKKKHHHRASNGGSIKRKDGTYDQSSPLNDCPLSDGEVGQVLSNGGEKLAERMTKELDTSKSIDRGDGESEEEEEEEPIPDPKKHSTDEGTAYSEVNATEEMSTLVNYIEPVKFKSFELARMRKKYFEMSSFVETKGLEALKNSPTEFVEYNKKQLSRIYPKGTRVDSSNYMPQLFWNVGCQM

SEQ ID NO: 27111 - protein, 203 aa, Catharanthus roseus
MSEEIISVSDRFLLSLIEEHLLSDNSDDSSSELTSTEENWEEIFADFLNWSGSEIQKRGSPSSESCQSNSMAESCQEDSVVGTPPEAAAGGGCSKDWNRYKGVRRRPWGKFAAEIRDPKKKGSRIWLGTYETPEDAALAYDAAAFNMRGAKARLNFPHLIGSNISGPVRVNPRKRFPAEPSTTSSSSSSSSSENSGGRKKRRY

SEQ ID NO: 27112 - protein, 791 aa, Yersinia enterocolitica
MLMKFLYKIYLTWALTLLSSTAVYAAEAIVFSPQELDYIKTHPVVNYGIFPNSYPIEKFNSIGEHIGLTRDYIDIISTVTGIKFKPVFSNNDRESVTNLQSGKISLLTSTSISFAQTHGLISSVPIFTTWPLTVTRKATRHIATPDDLMEGYVSITDYSSLIEWFTKQFPGVNYKIVYSPEETIAEVINRQAEAAVVLSPTALYYMNVKYPGQLKISRPHSAKISLAMAAHPEDQILINIINKAIASISAKQQAELTAKWIISDTNIPLPKDYKLTFYVGGLATALLCLLLFVFYRYRRLKMELVRLGSKNNLELSVIAHELRTPLIGILTACEGLVDKIVSTSQRERLANVIHVTRELLDNLDLSLDNAKINAGSVTQNPQPQLLAELCDTTVKLFISFAETHGTTLQVRYQSKQFFLPHLFDGTLVSQALNNIVSNAIKHTHDGMVLIECSLLQVDGKNMFSIEVIDTGTGIPSKVLARLSEPFYQGKFSRTDSDTPHPKGTGLGLFVAKKNMHLTGGHLAIVSQPGVGSRVTIALPAIAAHYAIENPLPEGLHIIMPTEIPSSLSGEITQILDGCELPYYSAAEPLPAAARGPEIDLQLDVAQKHWQLHNKQGDSVIIPRPVYASALYLAITDLCNEEQPLESSSDSPELHLPTTIITESRRLLVVEDEPLLLEVQYELFSSMGFQVDAVANTQQAYQSWLQHHHTIIVTDCRLDESDGFELVRHLRKLMQDSPEPVLIIGQSASLKTEDAQRAREVGMDYLLQKPVAREQWQQLIRDYFASKEKEHD

SEQ ID NO: 27113 - protein, 229 aa, Oryctolagus cuniculus
ADKAPFDTDISTMTRFVMEEGRKAGGTGEMTQLLNSLCTAVKAISTAVRKAGIAHLYGIAGSTNVTGBZVKKLDVLDMLKSAFATSVLVSEEDKNAIIVEPEKRGKYVSNFDPLVPIFGIYYRKKSTDALQGRSTDETSKSLVAAGYDTMVADVHRTLVYGGIFLYPADKKSPDGKLRLLYQCNMAFIMATTGKQAILDIVQTPDHRAPVILGSPDDVQQFLYKKHAVK

SEQ ID NO: 27114 - protein, 648 aa, Gallus gallus
MKFRKQIQENEYIKIENAENSSKLTISSTKQEHCGCYTLVVENKLGSRQAQVNLTVVDKPDPPAGTPCASDIRSSSLTLSWYGSSYDGGSAVQSYTVEIWNSVDNKWTDLTTCRSTSFNVQDLQADREYKFRVRAANVYGISEPSQESEVVKVGEKQEEELKEEEAELSDDEGKETEVNYQTVTINTEQKVSDVYNIEERLGSGKFGQVFRLVEKKTGKVWAGKFFKAYSAKEKENIRDEISIMNCLHHPKLVQCVDAFEEKANIVMVLEMVSGGELFERIIDEDFELTERECIKYMRQISEGVEYIHKQGIVHLDLKPENIMCVNKTGTSIKLIDFGLARRLESAGSLKVLFGTPEFVAPEVINYEPIGYETDMWSIGVICYILVSGLSPFMGDNDNETLANVTSATWDFDDEAFDEISDDAKDFISNLLKKDMKSRLNCTQCLQHPWLQKDTKNMEAKKLSKDRMKKYMARRKWQKTGHAVRAIGRLSSMAMISGMSGRKASGSSPTSPINADKVENEDAFLEEVAEEKPHVKPYFTKTILDMEVVEGSAARFDCKIEGYPDPEVMWYKDDQPVKESRHFQIDYDEEGNCSLTISEVCGDDDAKYTCKAVNSLGEATCTAELLVETMGKEGEGEGEGEEDEEEEEE

SEQ ID NO: 27115 - protein, 298 aa, Mus musculus
MGDQALSFLKDFLAGGIAAAVSKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDLARTRLAADVGKGSSQREFNGLGDCLTKIFKSDGLKGLYQGFSVSVQGIIIYRAAYFGVYDTAKGMLPDPKNVHIIVSWMIAQSVTAVAGLVSYPFDTVRRRMMMQSGRKGADIMYTGTLDCWRKIAKDEGANAFFKGAWSNVLRGMGGAFVLVLYDEIKKYV

SEQ ID NO: 27116 - protein, 478 aa, Mus musculus
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQRWFGFAGTPGYLSPEVLRKDPYGKPVDLWACGVILYILLVGYPPFWDEDQHRLYQQIKARAYDFPSPEWDTVTPEAKDLINKMLTINPSKRITAAEALKHPWILHRSTVASCMHRQETVDCLKKFNARRKLKGAILTTMLATRNFSGGKSGGNKKNDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 27117 - protein, 1099 aa, Drosophila melanogaster
MHPAGEKRGGRPNDKYTAEALESIKQDLTRFEVQNNHRNNQNYTPLRYTATNGRNDALTPDYHHAKQPMEPPPSASPAPDVVIPPPPAIVGQPGAGSISVSGVGVGVVGVANGRVPKMMTALMPNKLIRKPSIERDTASSHYLRCSPALDSGAGSSRSDSPHSHHTHQPSSRTVGNPGGNGGFSPSPSGFSEVAPPAPPPRNPTASSAATPPPPVPPTSQAYVKRRSPALNNRPPAIAPPTQRGNSPVITQNGLKNPQQQLTQQLKSLNLYPGGGSGAVVEPPPPYLIQGGAGGAAPPPPPPSYTASMQSRQSPTQSQQSDYRKSPSSGIYSATSAGSPSPITVSLPPAPLAKPQPRVYQARSQQPIIMQSVKSTQVQKPVLQTAVARQSPSSASASNSPVHVLAAPPSYPQKSAAVVQQQQQAAAAAHQQQHQHQQSKPPTPTTPPLVGLNSKPNCLEPPSYAKSMQAKAATVVQQQQQQQQQQQVQQQQVQQQQQQQQQQLQALRVLQAQAQRERDQRERERDQQKLANGNPGRQMLPPPPYQSNNNNNSEIKPPSCNNNNIQISNSNLATTPPIPPAKYNNNSSNTGANSSGGSNGSTGTTASSSTSCKKIKHASPIPERKKISKEKEEERKEFRIRQYSPQAFKFFMEQHIENVIKSYRQRTYRKNQLEKEMHKVGLPDQTQIEMRKMLNQKESNYIRLKRAKMDKSMFVKLKPIGVGAFGEVTLVSKIDTSNHLYAMKTLRKADVLKRNQVAHVKAERDILAEADNNWVVKLYYSFQDKDNLYFVMDYIPGGDLMSLLIKLGIFEEELARFYIAEVTCAVDSVHKMGFIHRDIKPDNILIDRDGHIKLTDFGLCTGFRWTHNSKYYQENGNHSRQDSMEPWEEYSENGPKPTVLERRRMRDHQRVLAHSLVGTPNYIAPEVLERSGYTQLCDYWSVGVILYEMLVGQPPFLANSPLETQQKVINWEKTLHIPPQAELSREATDLIRRLCASADKRLGKSVDEVKSHDFFKGIDFADMRKQKAPYIPEIKHPTDTSNFDPVDPEKLRSNDSTMSSGDDVDQNDRTFHGFFEFTFRRFFDDKQPPDMTDDQAPVYV

SEQ ID NO: 27118 - protein, 441 aa, Drosophila melanogaster
MASASTENGEELMNYGSNSDSEESEYSENEDTQVCDKDSQQNSNADSGYPLDSPELQDSKTTGQKGQNKSGKTSIGAVHPNYGFGKRWSKSEDVLLKQLVETHGENWEIIGPHFKDRLEQQVQQRWAKVLNPELIKGPWTRDEDDMVIKLVRNFGPKKWTLIARYLNGRIGKQCRERWHNHLNPNIKKTAWTEKEDEIIYQAHLELGNQWAKIAKRLPGRTDNAIKNHWNSTMRRKYDVERRSVNASGSDLKSSRTHLITLIKSGGISKCMNNMQHNKESGGEAVNKSENADGASVTAVKGGDLAQESQDDHQKGSNLAHLSMQHLIKLTMPRQTPIILKRTRKHIPETHHQAGCSSSETFNQEEAAGNARSRPPSSPVISPIKSLPFSPSHFLKSPCLTTFEDMDLRASTPVTKVYNRVGMEIKKEMETSSIETPHKSKY

SEQ ID NO: 27119 - protein, 430 aa, Mus musculus
MALRVTRNTKINAENKAKVSMAGAKRVPVTVTAASKPGLRPRTALGDIGNKVSEELQATVPLKREAKTLGTGKGTVKALPKPVEKVPVCEPEVELAEPEPEPELEHVREEKLSPEPILVDNPSPSPMETCGCAPAEEYPCQAFSDVILAVSDVDADSGADPNLCSEYVKDIYAYLRQLEEEQSVRPKYLQGREVTGNMRAILIDWLIQVQMKFRLLQETMYMTVSIIDRFMQNSCVPKKMIQLVGVTAMFIASKYEDMYPPEIGDFAFVTNNTYTKHQIRQMEMKILRVLNFSLGRPLPLHFLRRASKVGEVDVRQHTLAKYLMELSMLDYDMVHFAPSRAFSGAFCLALEILDNGEWTPTLQHYLSYSEDSLLPVMQHLAKNVVMVNCGLTKHMTVKNKYAASKHAKISTLAQLNCTHVQNLSKAVTKA

SEQ ID NO: 27120 - protein, 523 aa, Mus musculus
MSEDKITGTLAFTVFTAVLSSFQFGYDIGVINAPQEVIISHYRHVLGVPLDDRKAAINYDVNGTDTPLTVTPAYTTPAPWDEEETEGSAHIVTMLWSLSVSSFAVGGMVASFFGGWLGDKLGRIKAMLAANSLSLTGALLMGCSKFGPAHALIIAGRSVSGLYCGLISGLVPMYIGEIAPNTLRGALGTLHQLALVTGILISQIAGLSFILGNQDHWHILLGLSAVPALLQCLLLLFCPESPRYLYIKLEEEVRAKKSLKRLRGTEDVTKDINEMKKEKEEASTEQKVSVIQLFTDANYRQPILVALMLHMAQQFSGINGIFYYSTSIFQTAGISQPVYATIGVGAINMILTAVSVLLVEKAGRRTLFLTGMIGMFFCTIFMSVGLVLLDKFAWMSYVSMTAIFLFVSFFEIGPGPIPWFMVAEFFSQGPRSTALALAAFSNWVCNFVIALCFQYIADFLGPYVFFLFAGVVLVFTLFTFFKVPETKGKSFEEIAAEFRKKSGSAPPRKAAVQMEFLASSESV

SEQ ID NO: 27121 - protein, 448 aa, Mus musculus
MKGFIDDANYSVGLLDEGTNLGNVIDNYVYEHTLTGKNAFFVGDLGKIVKKHSQWQTVVAQIKPFYTVKCNSTPAVLEILAALGTGFACSSKNEMALVQELGVSPENIIFTSPCKQVSQIKYAAKVGVNIMTCDNEIELKKIARNHPNAKVLLHIATEDNIGGEDGNMKFGTTLKNCRHLLECAKELDVQIIGVKFHVSSACKEYQVYVHALSDARCVFDMAGEFGFTMNMLDIGGGFTGTEIQLEEVNHVISPLLDIYFPEGSGIQIISEPGSYYVSSAFTLAVNIIAKKVVENDKFSSGVEKNGSDEPAFVYYMNDGVYGSFASKLSEDLNTIPEVHKKYKEDEPLFTSSLWGPSCDELDQIVESCLLPELNVGDWLIFDNMGADSFHEPSAFNDFQRPAIYFMMSFSDWYEMQDAGITSDAMMKNFFFAPSCIQLSQEDSFSTEA

SEQ ID NO: 27122 - protein, 248 aa, Mus musculus
MERASLIQKAKLAEQAERYEDMAAFMKSAVEKGEELSCEERNLLSVAYKNVVGGQRAAWRVLSSIEQKSNEEGSEEKGPEVKEYREKVETELRGVCDTVLGLLDSHLIKGAGDAESRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADSAGEEGGEAPDDPHI

SEQ ID NO: 27123 - protein, 410 aa, Coxiella burnetii
EFGESGPDPLITQQHMEELKKLYGRYQNAIKRYGKKAPATLKHQKALAELFSTFKLSIKQFNRLTGQLRRMLRAARAQERLIMSYCVVKAKTPRKKFIASFPHNETNMKWLEQYKNENKEQAKRLEKYSKEIYRAQRNLAQLEEQNNLNIQEIKEINRRVAIGEAKSRRAKKEMIEANLRLVISIAKKYTNRGLQFLDLIQEGNIGLMKAVDKFEYRRGYKFSTYATWWIRQAITRSIADQARTIRIPVHMIETINKLNRISRQILQETGIEATPEELGRRMDMPEEKVRKVLKIAKEPISMETPIGEDEDSNLGDFIEDINMESPVDFATSAGLMEATRRNFVYAYPARSQVLRMRFGIDMNTDHTLEEVGNNSDVTRERIRQIEAKALRKLRHPSRAEKLHSFIEVEE

SEQ ID NO: 27124 - protein, 428 aa, Carassius auratus gibelio
MSSVGQTQRIAVQDPGADIHNQENMLSRLRCAAKNRIENRENVNPKPGNRTVLGALENNQRRPPVLRAAKQVSGPQITACKSEEHGNFGEKSSIRPPAFQIHVDEPDGACSKKPCTQRATMACSPLKLNPTVTRLRQPIATIDLPVEASFDSPMDMSIIDGEERPTNGNEVSDYAAEIHAHLREMEIKSKPRAGYMKKLPDITNSMRAILVDWLVVVGEKYKLQNETLYLAVNYIDRFLSSMSVHREKLQLVGTAAMLLASKFEEIYPPEVAEFVYITDDTYTKKQVLRMEHLVLTVLSFDLAAPTINQFLTQYFLHQPVSSKVESFSMFLGELSLIDCDPFLKYLPSQTAAAAFILANRTIAGGSWSKAFVEMTGYTLEDLMPCIQDLHQTYLGAAQHTQQAVREKYKGSKYHEVSLIELPEKLMLN

SEQ ID NO: 27125 - protein, 428 aa, Carassius auratus
MSSVGQTQRSAVQDPGADIHNQENMLSRLRGAAKNRIENRENVNPKPGNRTVLGALENNQRRPPVLRAAKQVSGPQITACKSEEHGSFGEKPSTRPPAFQIHVDEPDGACSKKQCTQRATMACSPLTLNPTVTRLRQPLATIDLPVEASFDSPMDMSIIDSEERPTNVNEVSDYAAEIHAHLREMEIKSKPKAGYMKKQPDITNSMRAILVDWLVEVGEEYKLQNETLYLAVNYIDRFLSSMSVLRGKLQLVGTAAMLLASKFEEIYPPEVAEFVYITDDTYTKKQVLRMEHLVLTVLSFDLAAPTINQFLTQYFLHQPVSSKVESLSMFLGELSLIDCDPFLKYLPSQTAAAAFILANHTIAGGSWSKAFVEMTGYTLEDLMPCIQDLHQTYLGAAQHTQQAVREKYKGSKYHEVSLIEPPEKLMLN

SEQ ID NO: 27126 - protein, 397 aa, Carassius auratus gibelio
MALRVSRNTRLASSENQSALPGKAAVANKPGLRPRAALGEIGNNPQTRQALRKKEVKVAPKVEVVAEKAPVVQQPKKESPKVQHDVPIVSEPSSPVPMETSGCASDDLCQAFSDVLLDIKDVDADDYDNPMLCSEYVKDIYLYLHQLEITQAVKPKYLEGKEITGNMRAILIDWLVQVQIKFRLLQETMYMTVAIIDRFLQDHPVPKKQLQLVGVTAMFIASKYEEMYPPEIADFAFVTDRAYTTGQIREMEMKILRVLDFSFGRPLPLQFLRRASKIGDVTAEHHTLAKYFLELTMVDYEMVHFPPSQVASAAYALTLKVFNCGDWTPTLQHYMGYTEDALVPVMQHIAKNVVRLNEGLSKHLAVKNKYSSQKQMRIASISQLKSSLIKDLAKQIS

SEQ ID NO: 27127 - protein, 397 aa, Carassius auratus
MALRVSRNTRLASSENQSALPGKAAVANKPGLRPRAALGEIGNNPQTRQALRKKEVKVAPKVEVVAEKAPVVQQPKKESPKVQHDVPIVSEPSSPVPMETSGCASDDLCQAFSDVLLDIKDVDADDYDNPMLCSEYVKDIYLYLHQLEITQAVKPKYLEGKEITGNMRAILIDWLVQVQIKFRLLQETMYMTVAVIDRFLQDHPVPKKQLQLVGVTAMFIASKYEEMYPPEIADFAFVTDRAYTTGQIRDMEMKILRVLDFSFGKPLPLQFLRRASKIGDVTAEHHTLAKYFLELTMVDYDMVHFPPSQVASAAYALTLKVFNCGDWTPTLQHYMGYTEDSLVPVMQHIARNVVRVNEGLSKHLAVKNKYSSQKQMRIASISQLKSSLIKDLAKQIS

SEQ ID NO: 27128 - protein, 159 aa, Brassica napus
MSESNKKISLISSEGEAFEVSEAVAREFEIVAHMLEDGCSGSSIPITTVDSNILGKVIEYCTKHVEVGNVEGNSEKAEKDLEEFDKRFIAVEMNTLFSLILAANYLNVKGLLNIGCQKVADTIKDMKPEEVRSIFNIENDYTPAEEEVVRKENEWAFQP

SEQ ID NO: 27129 - protein, 388 aa, Mus musculus
MTRDDALPDSHSAQTFYENYEPKEILGRGVSSVVRRCIHKPTCQEYAVKIIDITGGGSFSSEEVQELREATLKEVDILQKVSGHPNIIQLKDTYETNTFFFLVFDLMKRGELFDYLTEKVTLTEKETRKIMRALLEVICTLHKLNIVHRDLKPENILLDDNMNIKLTDFGFSCQLQPGEKLREVCGTPSYLAPEIIQCSMDDGHPGYGKEVDMWSTGVIMYTLLAGSPPFWHRKQMLMLRMIMDGKYQFGSPEWDDYSDTVKDLVSRFLVVQPQDRCSAEEALAHPFFQEYVVEEVRHFSPRGKFKVICLTVVASVKIYYQYRRVKPVTREIVIRDPYALRPLRRLIDAYAFRIYGHWVKKGQQQNRAALFENTPKAVLLSLAEEEDF

SEQ ID NO: 27130 - protein, 297 aa, Mus musculus
MEDYIKIEKIGEGTYGVVYKGRHRVTGQIVAMKKIRLESEEEGVPSTAIREISLLKELRHPNIVSLQDVLMQDSRLYLIFEFLSMDLKKYLDSIPPGQFMDSSLVKSYLHQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDNLFRIFRALGTPNNEVWPEVESLQDYKNTFPKWKPGSLASHVKNLDENGLDLLSKMLVYDPAKRISGKMALKHPYFDDLDNQIKKM

SEQ ID NO: 27131 - protein, 186 aa, Homo sapiens
PVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 27132 - protein, 296 aa, Danio rerio
EKVVVKILKPVKKKKIKREIKILENLRGGPNIITLLDIIKDPVSRTPALVFEHVNNTDFKQLYQTLSDYDIRFYMYEILKALDYCHSMGIMHRDVKPHNVMIDHEHRKLRLIDWGLAEFYHPNQEYNVRVASRYFKGPELLVDYQMYDYSLDMWSLGCMLASMIFRKEPFFHGQDNYDQLVRIAKVLGTEDLYDYIDKYNIELDPRFNDILGRHSRKRWERFVHSENQHLVSTEALDFLDKLLRYDHQARLTARGAMDHPYFYPIVKDQGRGAPAAGMAASSTPVSSSSLMAGIAL

SEQ ID NO: 27133 - protein, 209 aa, Marthasterias glacialis
VYKAKDTEEKNRIVAVKKIKLGHRSERKDGVNRTALREIKLLQELKHDNIIGLLDVFGHRSNISLVFDFMDTDLEVIIQDNSIVLKPGDIKAYTLMTLKGLEYLHRHWILHRDMKPNNSLIDTRGVLKIGDFGLAKFYGTGNRVYTHQVVTRWYRCPELLFGARIYGVGVDMWALGCILAELLLRVPFLPGESDLDQLTRISQTLGTVT

SEQ ID NO: 27134 - protein, 160 aa, Stellaria longipes
VSNYPPLPKPDLIKGLSAHTDAGGIILLSEDDKVSGLELLKDSDWIDVPPMRHSIVVNLGDELEVITNGKYWSVMHRVQIDTNITRMSTASFYVPGNDRVIAPAEALPKEFKDDEVYPKFVFKSYMKAYAKLIRQSGLKFEAKEPRFEAMKAHRIGSSCN

SEQ ID NO: 27135 - protein, 235 aa, Mus musculus
MNYKIYKKAKNTICQNSFGNEEKKKEPAISSQNSPEAREESSSSSNVSSRKDETNARDTYVSSFPRAPSTSDSVRLKCREMLAAALRTGDDYVAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 27136 - protein, 289 aa, Mus musculus
PKRYYLSNQERPQYEHSVVVGRGSSHQVENEKKEKKPKKEKGLGCSDWKPEAGLSPPRKKGGGEPKTRRDSVDSRSSTTSSPKRPSLERSNSSKSKVETPTTPSSPSTPTFAPAVCLLAPCYLTGDSVRDKCVEMLSAALKAEDNFKDYGVNCDKLASEIEDHIYQELKSTDMKYRNRVRSRISNLKDPRNPGLRRNVLSGAISPELIAKMTAEEMASDELRELRNAMTQEAIREHQMAKTGGTTTDLLRCSKCKKKNCTYNQVQTRSADEPMTTFVLCNECGNRWKFC

SEQ ID NO: 27137 - protein, 323 aa, Homo sapiens [sequence omitted]

SEQ ID NO: 27138 - protein, 172 aa, Solanum tuberosum
MENYATIFPSASSSSSHHDEYISLMNSKSSISDDAKEELLFQGKNKAGFLGLMASMETPRDIITKKDEVIKSCKKKIKKPRCAFQTRSQVDILDDGYRWRKYGQKAVKNNKFPRSYYRCTHQGCNVKKQVQRLSKDEEVVVTTYEGMHSHPIDKSTDNFEHILSQMQIYTSF

SEQ ID NO: 27139 - protein, 148 aa, Schizosaccharomyces pombe
HMVKSLSLGATAVMMGGLLAGTTESPGEYYVREGQRYKSYRGMGSIAAMEGTGVNKNASTGRYFSENDAVRVAQGVSGLVVDKGSLLRFLPYLYTGLQHALQDIGTKSLDELHEAVDKHEVRFELRSSAATRKEGDIQGFATYEKRLY

SEQ ID NO: 27140 - protein, 323 aa, Mangifera indica
MESLSFPVINLEKLNGEERAATMEKIKDACENWGFFELVNHGIPIEELDTLERKTKEHYRKCMEQRFKELVASKALEGVQTEIKDMDWESTFYVRHLPQTNLKCTPDLDDEYRKVMKEFASKLEKLAEELLDLLCENLGLEKGYLKKTFYGSKGPTFGTKVSHYPPCPQPDLIKGLRAHTDADGIILLFQDDKVSGLPASERWAVDIDVPPMRHSIVVNLGDQLEVITNGKYKSVEHRVVAQRDGNGRMSIASFYNPGSDAVIYPAPPLLEPEAEEKKQVYPKFVCEDYMKLYARLKFQAKEPRFEAMKAVETTVNLGPIATA

SEQ ID NO: 27141 - protein, 470 aa, Zygosaccharomyces mrakii
MFSLLLLTSTALVETALGVSPSYNGLGLTPQMGWNNWNTFACNVTEQLLLGTADRISELGLKDVGYNYVILDDCWSGGRSSNGSLVPDLNKFPHGMKYVADHLHDQDLLFGMYSSAGEYTCAGYPGSLGHEEKDAQFFARNEVDYLKYDNCYNKGQFGTPQASYERYKAMSDALNNTGRPIFYSLCNWGQDLTFYWGSAIANSWRMSGDITADFDRPDSRCPCGDDEYDCKYAGYHCSIMNILNKAAPMGQNANPGGWNDLDMLEVGVGNLTDDEEKAHFSMWAMVRSPLIIGADVNHLKPSSFSIYAQSPVIAINQDPRGVPATRVWRRQVSDTDAYGRGEVQFWSGPLENGDQVIAFLNGGNRMRPMNAGLDDIFFDSHPGAPELNSTWAVYDLWANRMEDSVASDILNGNRSSNGLLYNSTQQSYSQGLARNDSRLFGSQIGTIQAGGRLNVTVPAHGVGLYRLRLQ

SEQ ID NO: 27142 - protein, 376 aa, Rattus norvegicus
MSTAGKVIKCKAAVLWEPHKPFTIEDIEVAPPKAHEVRIKMVATGVCRSDDHAVSGSLFTPLPAVLGHEGAGIVESIGEGVTCVKPGDKVIPLFSPQCGKCRICKHPESNLCCQTKNLTQPKGALLDGTSRFSCRGKPIHHFLSTSTFSQYTVVDDIAVAKIDAAAPLDKVCLIGCGFSTGYGSAVQVAKVTPGSTCAVFGLGGVGLSVVIGCKTAGAAKIIAVDINKDKFAKAKELGATDCINPQDYTKPIQEVLQEMTDGGVDFSFEVIGRLDTMTSALLSCHSACGVSVIVGVPPSAQSLSVNPMSLLLGRTWKGAIFGGFKSKDAVPKLVADFMAKKFPLEPLITHVLPFEKINEAFDLLRAGKSIRTVLTF

SEQ ID NO: 27143 - protein, 384 aa, Rattus norvegicus
RARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMSSAGMAGGSTPVSSANMMSGISSVPTPSPLGPLAGSPVIAAANSLGIPVPAAAGAQQ

SEQ ID NO: 27144 - protein, 802 aa, Saccharum officinarum
  unsure (1)..(802): unsure at all Xaa locations
MAAKLTRLHSLRERLGATFSSHPNELIALFSRYVNQGKGMLQRHQLLAEFDALFDSDKEKYAPFEDFLRAAQEAIVLPPWVALAIRPRPGVWDYIRVNVSELAVEELSVSEYLAFKEQLVDGNSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGLGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAVGTTCGQRLEKVIGTEHTDIIRIPFRNENGILRKWISRFDVWPYLETYTEDVASEIMLEMQAKPDLIVGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSXGADMSVYYPYTETDKXLTAFHPEIEELIYSDVENDEHKFVLKDKNKPIIFSMARLDRVKNMTGLVEMYGKNARLRELANLVIVAGDHGKESKDREEQAEFKKMYSLIDEYNLKGHIRWISAQMNRVRNAELYRYICDTKGAFVQPAFYEAFGLTVIESMTCGLPTIATCHGGPAEIIVDGVSGLHIDPYHSDKAADILVNFFEKCKADPSYWDKISQGGLQRIYEKYTWKLYSERLMTLTGVYGFWKYVSNLERRETRRYLEMFYALKYRSLASAVPLSFD

SEQ ID NO: 27145 - protein, 443 aa, Takifugu rubripes
MAAYNGGSSAVAAHHPHHHHQLQHLPPPHMHHHHHHQHHQQQHQQHHLQQQLDIEPDRPIGYGAFGVVWSVTDPRDGKRVALKKMPNVFQNLVSCKRVFRELKMLCFFKHENVLSALDMLQPPHIDYFEEIYVVTELMQSDLHKIIVSPQPLSSDHAKVFLYQILRGLKYLHSAGILHRDIKPGNLLVNSNCVLKICDFGLARVEESDEARHMTQEVVTQYYRAPEILMGSRHYSNSIDIWSVGCIFAELLGRRILFQAQSPIQQLDLITDLLGTPSMEAMRTACEGARAHILRGPHKQPSLPVLYTLSSQATHEAVHILCRMLVFDPSKRISAKDALAHPYLDEGRLRYHTCMCKCCYTTSSGRVYTSDFEPVTNPKFDDGFEKNLSSVRQVKEIIHQFILEQQKGSRVPLCINPQSAAFKSFISSTVPQPSEMPPSPLVWE

SEQ ID NO: 27146 - protein, 323 aa, Candida shehatae
MSPSPIPAFKLNNGLEMPSIGFGCWKLDKSTAADQVYNAIKAGYRLFDGAEDYGNEQEVGEGVKRAIDEGIVTREEIFLTSKLWNNYHDPKNVETALNKTLKDLKVDYVDLFLIHFPIAFKFVPIEEKYPPGFYCGDGDNFVYEDVPILETWKALEKLVKAGKIRSIGVSNFPGALLLDLFRGATIKPAVLQVEHHPYLQQPKLIEYAQKVGITVTAYSSFGPQSFVEMNQGRALNTPTLFEHDVIKAIAAKHNKVPAEVLLRWSAQRGIAVIPKSNLPERLVQNRSFNDFELTKEDFEEISKLDINLRFNDPWDWDNIPIFV

SEQ ID NO: 27147 - protein, 187 aa, Mus musculus
MAADISQWAGPLCLQEVDEPPQHALRVDYAGVTVDELGKVLTPTQVMNRPSSISWDGLDPGKLYTLVLTDPDAPSRKDPKFREWHHFLVVNMKGNDISSGTVLSDYVGSGPPSGTSLHRYVWLVYEQEQPLSCDEPILSNKSGDNRGKFKVETFRKKYNLGAPVAGTCYQAEWDDYVPKLYEQLSGK

SEQ ID NO: 27148 - protein, 526 aa, Arabidopsis thaliana
MGQTNSETQQARLYTQNSQKQLLRSFLLLHLIFGYQSHKTLRMAAATQFLSQPSSLNPHQLKNQTSQRSRSIPVLSLKSTLKPLKRLSVKAAVVSQNSSKTVTKFDHCFKKSSDGFLYCEGTKVEDIMESVERRPFYLYSKPQITRNLEAYKEALEGVSSVIGYAIKANNNLKILEHLRSLGCGAVLVSGNELRLALRAGFDPTKCIFNGNGKSLEDLVLAAQEGVFVNVDSEFDLNNIVEASRISGKQVNVLLRINPDVDPQVHPYVATGNKNSKFGIRNEKLQWFLDQVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPPAEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 27149 - protein, 339 aa, Arabidopsis thaliana
MADRSKGFMRAEFVTYAYILLYIALSSGQIFFNKWVLSSKEINFPYPLGLTLLHMIFSSVLCFLLTKVLKVILQLMFFLFLYVTSVIPIGAMFAMTLWLGNTAYLYISVAFAQMLKAIMPVAVFILGVAAGLEMMSCRMLLIMSIISFGVLVASYGELNINWIGVVYQMGGVVGEALRLIFMELLVKRKGIKLNPISLMYYVSPCSAICLFVPWIFLEKSKIDGNGPWNFHFVVLTLNSLCTFALNLSVFLVISHTSALTIRVAGVVKDWVVVLVSALLFADTKLTIINLFGYAIAIAGVAAYNNHKLKKEASKVVTTETPGDAESIPLVSQGNTNTER

SEQ ID NO: 27150 - protein, 133 aa, Arabidopsis thaliana
MQRQVALIKQSLFDQGYLDEQFMELEELQDDANPNFVEEVSALYFKDSARLINNIDQALERGSFDFNRLDSYMHQFKGSSTSIGASKVKAECTTFREYCRAGNAEGCLRTFQQLKKEHSTLRKKLEHYFQASQ

SEQ ID NO: 27151 - protein, 180 aa, Danio rerio
MGGLQKKKYESGSATNYITRNKARKKLSLSLADFRRLCILKGIYPHEPKHKKKVNKGSTAARTYYLLKDIRFLLHEPIVGKFREYKIFVRKLRKAYGKAEWSAVERLKENKPGYKLDHIIKERYPTFIDALRDVDDALSMCFLFSTFARTGKCHVQTIQLCRRLSVEWMNYIISSRSLRK

SEQ ID NO: 27152 - protein, 192 aa, Arabidopsis thaliana
MNTIVVAQLQRQFQDYIVSLYQQGFLDNQFSELRKLQDEGTPDFVAEVVSLFFDDCSKLINTMSISLERPDNVDFKQVDSGVHQLKGSSSSLCFVLSVGARRVKNVCISFKECCDVQNREGYSSNSHTNCDNDIWHRCLRCLQQVDYEYKMLKTKLQDLFNVSFKLCENLLVLLLEKQILQAGGTIPQVDIN

SEQ ID NO: 27153 - protein, 801 aa, Arabidopsis thaliana
MVGFPANQAKTVEEELPLQVVADQDPKVKTFKDSFDFPSIDSFPDFDSITWSESNRNVEDFSIEDTDFDFFEYHMEIPQEDVVTVSDVMCPENQTTVNSESIEGKLEVFNDDMSGEVGVSSVRSESMVEVKPVLCDVMSEEVGVSSVEVEPNVCVEMSANGGDEPAVKDSEPVVSENSRSMEGETEPVVVSDASVACPTMDLDESGLKKTDEGLACSIEVGLEKVSLAVDDDEKSDEAKGEMDSAESESETSSSSASSSDSSSSEEEESDEDESDKEENKKEEKFEHMVVGKEDDLAGELEEGEIENLDEENGDDDIEDEDDDDDDDDDDDDDVNEMVAWSNDEDDDLGLQTKEPIRSKNELKELPPVPPVDVTLEPHHATLPVGVVLSVMSAQVIVEGMEKHSPLTEGSILWITEKRTPLGLVDEIFGPVKCPYYIVRFNSESEVPEGVCQGTPVSFVADFAQHILNIKELQKKGYDASGDNDEEIPDELEFSDDEKEAEYRRMQKLEKRGMMSDQKTGNTRNKKKKNRDPGRPTSSYSGEWTKNQGSSSLSSNRSDPQMGGPRPQMDGFPPNNAAWRPQSNQQNPYQLPPIPNQMGMQIPFMAMQNQNQMMFQPQFNGGQMPMPGGPGGLNFFPGQASAPWPAMVGQNCFNQQFGMGRGIQQQPLPNELSFNMFSQGLQMHPPQSQMHRPQSQMNPQFQMPPQFQPHQQSPMNPQYQMMHRPQSPANPQFQMQAQSDVRPLQSQIPQSPSDLQSPMEPQSQGFSSGQSSERGRGFHGRGRGRGRGRFGRGRGRGRQQSG

SEQ ID NO: 27154 - protein, 399 aa, Arabidopsis thaliana
MQSGGDFSNGFHGDHHRELELEDKQGPSLSSFGRAKKRSHAGARDPRGGLANVLRVSDQLGEHKSLETSESSPPPCTDFDVAYFHSYAHVGIHEEMIKDRARTETYREAIMQHQSLIEGKVVVDVGCGTGILSIFCAQAGAKRVYAVDASDIAVQAKEVVKANGLSDKVIVLHGRVEDVEIDEEVDVIISEWMGYMLLYESMLGSVITARDRWLKPGGLILPSHATLYMAPISHPDRYSHSIDFWRNVYGIDMSAMMQLAKQCAFEEPSVESISGENVLTWPEVVFPLEFSGPASSPAKNTSETSIASGSSSISPSGEVNQKKRTNPSDALVLSTSPESPPTHWQQTIVYFYDPIDVEQDQVIEGSVTLSQSKENKRFMNIHLEYSSAGRSFVKESVMR

SEQ ID NO: 27155 - protein, 619 aa, Arabidopsis thaliana
MGASHSTNVNNHPHSRNASNHPLTNSNSTSSRHSASSSDRLSVSNLRSQLTTIYRNQEEEEEEEEEEEEEEEGGKEKRAEEEAKSFSLVRDFDLSGLNCIRVSRRNYILMDPHKKVALETEFFTEYGEASRYQIQEVIGKGSYGVVASAIDTHSGEKVAIKKINDVFEHVSDATRILREIKLLRLLRHPDIVEIKHVMLPPSRREFRDIYVVFELMESDLHQVIKANDDLTPEHYQFFLYQLLRGLKFIHTANVFHRDLKPKNILANSDCKLKICDFGLARVSFNDAPSAIFWTDYVATRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKITKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQTGYSARSLLKSASISASKCIGMKPRNKSEYGESNNDTVDALSQKVAALHT

SEQ ID NO: 27156 - protein, 231 aa, Arabidopsis thaliana
MAADTRSLSKMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 27157 - protein, 845 aa, Arabidopsis thaliana
MEGSSNSNSRGFNTSGVSDRNTEFLPVERLTTRSKPSSHVDEYVRSLFGSTSTHKSGEDDSLGIDPFVRSLEWGDVSLRQWLDKPERSVDVFECLHVFRQIVEIVNAAHSQGIVVHNVRPSCFVMSSFNHVSFIESASCSDSGSDSLEDGPISQKEIGSSRREEAVSKAIAIEEKGVYNKLLERKIEKLEEEKTQPFPMKHILAMETSWYTSPEEDFGSSSTCASDVYRLGVLLFELFCPVPSREEKSRTMSSLRHRVLPPQILLKCPKEASFCLWLLHPEPTCRPSMSDLLQSEFITEPRDNLEEREAAIELRDRIEEQESLLEFLLLIQQRKQESAYRLQDTVSLLSSDIEQVVKRQLILKKRGSSLSDFSKDDHQYTSGQPLMSFQANEEPSAFLASRKRVRQGILALENGVEVDEESQGSTLLESSRLMRNFKKLESVYFLTRRRQMKAAASGKSLTRHSPLSSENGRGSMIVSEKSSVSNPVAPKAFFNNDSRQGGWIDPFLEGLCRYLSFSQLRVKADLKQGDLLNSSNLVCALAFDREGELFATAGVNKKIKIFECNSIVNDNRDIHYPVVELAGRSKLSSLCWNSYIKSQIASSNFDGVVQIWDVARSQLVTEMKEHKKRVWSIDISSADPTLLASGSDDGTVKLWSINQGVSIGTIKTKANVCCVQFPSDSGRSLAFGSADHKVYYYDLRNPKIPLCTMIGHSKTVSYVKFVDSSTLVSSSTDNTLKLWDLSMSASGINESPLHSFTGHTNLKNFVGLSVSDGYIATGSETNEVFVYHKAFPMPVMSYMFNNTDSMSGLEVDDASQFISSICWRGQSSTLVAANSNGNIKILEMMT

SEQ ID NO: 27158 - protein, 251 aa, Arabidopsis thaliana
MGRGRVQLRRIENKIRRQVTFSKRRTGLVKKAQEISVLCDAEVALIVFSPKGKLFEYSAGSSMERILDRYERSAYAGQDIPTPNLDSQGECSTECSKLLRMIDVLQRSLRHLRGEEVDGLSIRDLQGVEMQLDTALKKTRSRKNQLMVESIAQLQKKEKELKELKKQLTKKVKAGEREDFQTQNLSHDLASLATPPFESPHELRRTISPPPPPLSSGDTSQRDGVGEVAAGTLIRRTNATLPHWMPQLTGE

SEQ ID NO: 27159 - protein, 593 aa, Arabidopsis thaliana
MFQNMKEMEFFTEYGDANRYRILEVIGKGSYGVVCAAIDTQTGEKVAIKKINDVFEHVSDALRILREVKLLRLLRHPDIVEIKSIMLPPSKREFKDIYVVFELMESDLHQVIKANDDLTREHHQFFLYQMLRALKYMHTANVYHRDLKPKNILANANCKLKVCDFGLARVSFNDTPTTVFWTDYVATRWYRAPELCGSFCSKYTPAIDIWSIGCIFAEVLTGKPLFPGKSVVHQLDLITDLLGTPKSETIAGVRNEKARKYLNEMRKKNLVPFSQKFPNADPLALRLLQRLLAFDPKDRPTAAEALADPYFKCLAKVEREPSCQPISKMEFEFERRRLTKDDIRELIYREILEYHPQLLKDYMNSEGSSFLYPSAIGHLRKQFAYLEENSGKSGPVIPPDRKHASLPRSAVHSSAVNSNAQPSLNASDSRRVSIEPSRNGVVPSTSAYSTKPLGPPPRVPSGKPGRVVESSVTYENDRNLKESSYDARTSYYRSTVLPPQTVSPNCYFLPNTMNQEKRSGTEAASQPKPQFVPTQCNSAKPAELNPNPYVQSQHKVGIDAKLLHAQSQYGPAGAAAVAVAAHRNIGAVGYGMS

SEQ ID NO: 27160 - protein, 1398 aa, Arabidopsis thaliana
MTKALNLGFPTNSYAFVFLVASSKSLTSKTLKIFQRVSASERESYLFSREVRVLEIDNWIYGWIWCKSGSSSPDSSNSPRSVGSNSPIRSDKKKSKSASKDEPPIPIPGFVGVGCKQTQIKDGLKKKDGSSKGKQLSSEVQAHSIGKSNLSPSSEVKKPPPPEVKEGPAFVSPIMASSLGLNRIKTRSGPLPQERVFNYRNDPATSNLSKMGADGGDLGSGSATSGSGSGNRKKEAGSSKLGLEENMDRTRPSDNKSDRDSLSPDTGPPRSLSPTLPPSGSRLQNVASSSGTGMSLDTNNILKWLMGILNGNYERNTYWQLAVLVLVINLFRVLLVMSMLACRSEMSSGRSGPLRNSDFCTPENSYEWENPKESESPRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWPHVPEEMSAEAHDIIDRFLTEDPHQRLGARGAAEVKQHIFFKDINWDTLARQKAAFVPASESAIDTSYFRSRYSWNTSDEQFFPSELVGKLLSLVFVGYAISLNWINVATQAEECEGHAEFESGIPVDYSFSNFSFKNLSQLASINYDLLSKGWKDEPQQIPHHK

SEQ ID NO: 27161 - protein, 498 aa, Arabidopsis thaliana
MAASYEEERDIQKNYWIEHSADLTVEAMMLDSRASDLDKEERPEVLSLLPPYEGKSVLELGAGIGRFTGELAQKAGELIALDFIDNVIKKNESINGHYKNVKFMCADVTSPDLKITDGSLDLIFSNWLLMYLSDKEVELLAERMVGWIKVGGYIFFRESCFHQSGDSKRKSNPTHYREPRFYSKIDGETMKVFQECQTRDAAGNSFELSMIGCKCIGAYVKNKKNQNQICWIWQKVSSENDRGFQRFLDNVQYKSSGILRYERVFGQGFVSTGGLETTKEFVEKMNLKPGQKVLDVGCGIGGGDFYMAEKFDVHVVGIDLSVNMISFALERAIGLSCSVEFEVADCTTKHYPDNSFDVIYSRDTILHIQDKPALFRTFFKWLKPGGKVLISDYCRSPKTPSAEFSEYIKQRGYDLHDVQAYGQMLKDAGFTDVIAEDRTDQFMQVLKRELDRVEKEKEKFISDFSKEDYDDIVGGWKSKLERCASDEQKWGLFIANKN

SEQ ID NO: 27162 - protein, 243 aa, Medicago truncatula
MGKSLFQESLKALEADIQYANTLALGHPRDKEGGCFQMRLSYSPVAPLFLSLVQWTDYRLAGALGLLRILIYVTYGNGKTTISIYERKASIRQFYSIIFPALLQLQKGVTDLEERKQKEVYANRYQKKTDFKDRRESKIDIEREKECGVCLEVKAKVVLPNCCHQMCFKCYREWCLRSQSCPFCRDSLKRVNSGDLWIYTDTSDIVDVGTIFKENCKILFLYIEKLPLIIPDPRHVSYDPFFR

SEQ ID NO: 27163 - protein, 1166 aa, Ustilago maydis
MPPLPYRRSSSLLPVTHSGTSTVARATTSLATRTPIHLTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHSSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 27164 - protein, 727 aa, Equus caballus
MEGERKNNNKRWYFTREQLENSPSRRFGLDPDKELSYRQQAANLLQDMGQRLNVSQLTINTAIVYMHRFYMIQSFTQFHRNSVAPAALFLAAKVEEQPKKLEHVIKVAHACLHPQESLPDTRSEAYLQQVQDLVILESIILQTLGFELTIDHPHTHVVKCTQLVRASKDLAQTSYFMATNSLHLTTFSLQYTPPVVACVCIHLACKWSNWEIPVSTDGKHWWEYVDATVTLELLDELTHEFLQILEKTPNRLKRIRNWRACQAAKKTKADDRGTDENTSEQTILNMISQSSSDTTIAGLMSMSTSSTTSTVPSLPTTEESSSNLSGVEMLQGERWLSSQPPFKLEPAQGHRTSENLALIGVDHSLQQDGSNAFISQKQNSSKSVPSAKVSLKEYRAKHAEELAAQKRQLENMEANVKSQYAYAAQNLLSHHDSHSSVILKMPIEGSENPERPFLEKPDKTALKMRIPVASGDKAASSKPEEIKMRIKVHAAPDKHNSIDDSVTKSREHKEKHKTHPSNHHHHHNHHSHKHSHSQLPAGTGNKRPGDPKHSSQTSTLAHKTYSLSSSFSSSSSSRKRGPPEETGGALFDHPAKIAKSTKSSSINFFPPLPTMAQLPGHSSDTSGLPFSQPSCKTRVPHMKLDKGPTGANGHNTTQTIDYQDTVNMLHSLLHAQGVQPTQPPALEFVHSYGEYLNPRAGGMPSRSGNTDKPRLPPLPSEPPPPLPPLPK

SEQ ID NO: 27165 - protein, 353 aa, Rattus norvegicus
MACCLSEEAKEARRINDEIERQLRRDKRDARRELKLLLLGTGESGKSTFIKQMRIIHGSGYSDEDKRGFTKLVYQNIFTAMQAMVRAMDTLKIPYKYEHNKAHAQLVREVDVEKVSAFENPYVDAIKSLWNDPGIQECYDRRREYQLSDSTKYYLNDLDRVADPSYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 27166 - protein, 390 aa, Actinobacillus actinomycetemcomitans
MTKLIINLNVLNYPLTGIGYYTLNIVKELLNRNVELVGVKDSNILNKEHIFSLINQDIKGKKYSTTKKNLKIMVVNLLRKIPKIYYIRCKIKSLLLSTKMNVLAEKGYVYFEPCFVPLGYSGSIITTIHDLSFIQYPEFHPEERVKYLTSELPRTVRLSSIIFVDSDAIAVELKKLYPMYSNKVVTLYPGVDTSFKQYENCNDVLSSFGLKDKSFILSVCTLEPRKNLLRLVEAYKLLPESMKEEYPLVLVGDQGWKNSELFNSAKELFDKKQLIMTKYISDDLVKKIYSSAAIFAYPSLYEGFGLPIVEAMASGTAVITSNYGAMAEVAGDSAVLVNPHSTEELKDAIINLLTDIKFRNYFIDRGLNRAKIFSWNNTVDKLISVVDEIN

SEQ ID NO: 27167 - protein, 592 aa, Myxococcus xanthus
MSHPVSGLSGTDPSEVAPAPSLALVTERPAPLELTTRALGMGLLIGGLLAITNVYMGLKTGWWESGSVTAAVLGFSALASVSRRRGAPYTPLENNLTQTAAAAVGAMPAAAGLLGALPALALLGTSVPGWGVAVWSVALGVLGVLAAHLLRRRLVAQEALPFPTGIATAELITAMHASTGDTVRAGRGRLLAGAGVAAVAVTAARDAFKWLPGMTALPGTLAGLPAASLTWGVGWSPMLLAIGMMTGPRLGLSMLAGAAVAWGLLAPGLAGMGALADTRYETLSAWLTWPGVGLMVGSALAALLAQARDFLSAARDVSSLGRGAAVPSWALGAGLAACVLAVVVGSALFGLGVPYMLLALVLVLPLCAVCARGAGQVDVSPVTQMGQVTQVIFGALLPGAMAPNVAAGAVVSGAAAQTGVSMWSLKAGHLLGASARHQLAAQLVGVLAGSVVGVPVYLLLSRTYGLGSEALPAPFAHQFRAVAEVAVRGLDGLPPHAALAACVAVGVGALLTWVSRGRAARWLPLPVALGIGFILPAYYAVTLCLGALGLAAARWRWPQAADRNTSTLAAGAIAGESLAGVLIAALMAFGLT

SEQ ID NO: 27168 - protein, 2903 aa, Trypanosoma brucei
MPRYTAMRRLGPVGHSGGISSNGVTTVGAVTASNVGNGVVNIGGDGSQGVAMGPGATDVASARPLLIVPNTTSAAGGSADVSDEEVDQLLRELERSVDSPQAAAVMRDAVWAIERRAFSSCDPHSRDYFLESRVRIILMSLSTTSDVKQLLLAVDFIEALLAVPYTNLQHRFTRLCRSLMNILRCGIEEPAREAQRVLKRMLVTDSQFGAYHTPLRSFITKELRDNCKVALMRLYGRAQQANVSFTPDFLSTMLAAEATAEISPRFITGTLRQQVLELASMLAGFSDLLLRRAAYRCMVVLFKNTSAMRRKEVVLENRRIINEAIRSLNLSHNSESSIISTLETLRALLSSRGVHCMDKQVNTLPQLCVLVTEQHRISKTTAVRNAVCDLVPVIAETDISSAARRTTYCAIIMEPVKNVRDDSNKDLELRNLAIFIQNVGYEVLDSTNRVNLDSIIQRYITRRGTEEECWHILAAICSSRARPETQRTHMCSKTSYIAMSSSSAMQKGCETIQGHQSGGEISLSAQELRSASAEAHSVCQLVAGESQNSCNSHELMQPVEALVRRCLPHMVHAVLSDEFVRYITIIQDHLPSLSSDLQTYLDQLVNRTLRNDKRKYCGGEVEDGALVAQVFAGDRLSTELGNSQPQEDIIQSSTLAYVTAMGRLAQYLLPTTLPEGGAINWQQSQGATSTTATDGNGQGYSLGSVETFCKSVVAGQPQLVSPESTLSSAAGATTAEVCSGAAPDSVGASELKIALEVFSKRQITSSDQLREVSDIIIQYQRHPDKRVRQQCCTTVIEALKCWARYSQSDRTSAYSSLVPDLLEVYLKNVAMELDPKVRLVEVTLLADAVELRMFLREKRIIDTLISFLHDISHVREKTMELLVTLAQDNHTGPSVETVQYSLLIVVESSVAALEYSSDPRILIRHMSDLQTVAKFSLRPLMGHLDRTFVACRRRLVEEVVPDTIALSTLKTLRTILEAIKREEAVLLKYKDVALELYAPVAVALRASTASPLSHAAIGVLVCMHEIGASPLNWDARQLHELLQSVTAVYIEAANSTEEELGRALTLFGQIGAVDPATKPDTAAMKKKDDEAAIQDEADLELTYDYTKIVYRNLSRMLDLSLSESVCVQSMCTLLHLVRLTTDRKELIGGMHAIKAILQIARRANDAPLLRIEALHILAAITSLRHEKVCKTLLPELVTLFEQLWYPQDHALFRAVLNLVSALKPGNLTGKEQSEVWPWLYPRLVDVALQDHTETREFCLRVVGIIQHAKYIPPHCIPIVFPMLTQFVQQMDQLAELRSLSLCAAIRIVCNLQAVQHLPSLMHTICTLTRHCDLTENLGPRLSTPTLHRSLRLLSNTHPNGEADVNALCERLCATGSEGSADAGGCFTNEGGETLPTSTQPNSSFHCGNGDYASAPYLGQYTQKCQQQQQGGTYLDPNDDEAYDTLPQGQQDITAFMKHVEFGLRAKDNKWREWFAEFQKNMIVASPHPVFRIMVDLFDKHEPLRRKLFHPSFKCFYESLNAEHMKKVKDVLNLALRSSDTEVVSKCIGLADYLDHNPPNISESVLQQLRHLEGNEPMDVGKFTKHSNLHVGNVIAGSRSPTPACRHEPGGYYASHHGQLYRNISDNYNFESVLHSLNSPKTEGPVFNEGVRPPSHKVQDVGNGEHEVTDNGGTDSGCGVERNGKEGRSESESGDVNGSARRQTMLPVAKSIEGDTNEGLSFLAGPVARRITVSAHHTTNVNASDGTCPNTGDAEVHIRATAIPSTVNPLFTNDSLVEAALRTRMPDKAMSYLENKLLPVMQKYRYAHSVPKEAVQAVVLPLASLYSRLEMQDSVVGLFHAMRYKSDNEDGFAYELLQWWDVAQGVYATKVHDCCGSSARDIDGYVRMLCLCGEWERALQVVKDTYKSLDQPSSTIAQSGAMAAWILGKWDDVKMLIERLPNKEKGNITLRHFFQNATLFHQEFGCRAQWDCGVQDGQRRLETSPQVEALRASIMRAKMEVDESLKTLLPLSYAHAYENLTMLQHFTEMEEHIAYMESRTEEFRGQLRERWNRRFAALKPDSLMPNLRSLMLHSLVLNASEMSVMVVNFCERTGTNYPQLSKWAMEWLKQGKFPRANHLSQSCHVLPATPVSLEPCVAITYIGQVWSGGQRQKAVQLMENFLEETHSTLEEQQPAAYGVAQLRLGMWKQEMFADSFWKVEHRQEVLRHFHEAVRAVPGSCEAWHSWGLMNYRVQQRDCSLSRYEQRLFVEAAHQGFVAAICRSASPSTALPGVMRLLQLWVFHNGMSLLKESVADSVARIPTDYWVQAIPQLIGHLRSASHDVRDVVSMILQRLCVAHSQAVVFPLLVVLMSADGGGGETHSRRKELARSIINNLPKRIRAEAELVATLLINASATPIERIGESLSAVATAWNPNAEYEEDKEEVRRKLRYVLDVFNTNRRQLLYNVGDIGQYVRIVMEEDACGRREKASGILTQLVEEITKHISEKLGKEPQKAMEPLLNLRNLSIAVFGEYDIQYTNFPTIASFSSKLDVIPSKKRPRRIRLSGSNGCMYTYCLKGNEDIRMDERVMQLFGMVNVLLSDAKTAKSAFIHRFPVIPISDNVGLLGWVEHANTINNTICTHRNTISKVRTHHESNTLRAYVETIGSWEKLSMIRRTEILDYVMSQKDCEAVDVARAMWHRSNTAEQWLERRTAFTQSLATMSMVGYVLGLGDRHLGNILLSMSTGKIVHIDFGDSFDVGRLRHVLPETVPFRLTRMLTNAMEVFGVDGVFRASCNRTQSTLHKNADSIMALLTAFVHDPIVQHKGKMRNMMEKSRTPQNIVERIRNKLRGTEMAVRNADTVIFNTVLESSRRPDLLYMSHAFNDVAKRTVVNGRTTEEQVSMLIDEATRLENYAALYFGWGPLW

SEQ ID NO: 27169 - protein, 345 aa, Trypanosoma brucei
MTVDANAASSTTTTTDYYFDSYSHYGIHMEMLKDCHRTTSYRDAMWRNAYLFKDKVVLDVGCGTGILSMFAAKAGARKVIGVDCSTVAVQAREIVRDNGFEDVITIIQGKVEEIQLDEKVDIIISEWMGYFLLYESMLNTVLYARDNLGTPDVKMFPDKANMHVCGITDEQYIQERFNIWDNVQGIDFSYFKRLSFIEPLVDTVERSQIVTNVAPLVSFDINTVKEADLSFTSEFALEAQASRGKRNGGNSIIYVHALSVHFDTPFTAGHEVVILDTTPYSPPTHWRQTVLYLFNPLRMRAGERATFRMKCSPNALNGRDLDISLHVDFEGALQISHYDQDFRLR

SEQ ID NO: 27170 - protein, 265 aa, Hordeum vulgare subsp. vulgare
MGRGPVQLRRIENKINRQVTFSKRRSGLLKKAHEISVLCDAEVALIVFSTKGKLYEYSSQDSSMDVILERYQRYSFEERAVLDPSTGDQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHREQLNEATNIHHQEQLSGATTSSPSPTPPTAQDSMAPPNIGPYQSRGGGDPEPQPSPAQANNSNLPPWMLRTIGNR

SEQ ID NO: 27171 - protein, 244 aa, Hordeum vulgare subsp. vulgare
MGRRKVQLKRIENKINRQVTFSKRRSGLLKKAHEISVLYDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRARKNQLMHESISELQKKERSLQEENKVLQKELVEKQKAQAAQQDQTQPQTSSSSSSFMMRDAPPVADTSNHPAAAGERAEDVAVQPQVPLRTALPLWMVSHING

SEQ ID NO: 27172 - protein, 276 aa, Hordeum vulgare subsp. vulgare
MGRGKVQLKRIENKINRQVTFSKRRNGLLKKAHEISVLCDAEVAVIVFSPKGKLYEYATDSSMDKILERYERYSYAEKALISAESESEGNWCHEYRKLKAKIETIQKCHKHLMGEDLDSLNLKELQQLEQQLESSLKHIRSRKSHLMMESISELQKKERSLQEENKALQKELVERQKAASRQQQLQQQQQQQQMQWEHQAQTQTHTHTQNQPQAQTSSSSSSFMMRDQQAHAPQQNICSYPPVTMGGEATAAAAAPEQQAQLRICLPPWMLSHLNA

SEQ ID NO: 27173 - protein, 1173 aa, Homo sapiens [sequence omitted]

SEQ ID NO: 27174 - protein, 100 aa, Mycoplasma genitalium
ILNLNSGLPKVLNSTDEESRKYAINQLVTSNLRLVVSIAKKHLERGLDFNDLIQEGNLGLLKAISKFNWSLGNKFSTYATWWIKQAITRAIADQARTVRI

SEQ ID NO: 27175 - protein, 738 aa, Neurospora crassa
MAQRSRTAGTTADPRDPLLPPPSPAPDSSLHPHSPPRPLIEGKSFTARGVLVGLGVGLIICFSNMYFGLQTGWVSIMSMPASLMGFGVFRLLTQRLKFPFSPVENVLVQTVAGSMAIMPLGCGFVGVIPAMQFLLRDDEGGGPGLDLGLGKLVVWGLGLCYFGVVFGVPLRKQVIIREQLKFPSGFSTAVLISVLHGKTRQRASESERHEDPATFASLAAQEESGSAVVPGLDDDNNGNHHNLEGEEGGEAPAEPHSASWKRNLNLLLVCFLVSGIFTLSTYFIPALRSIPVFGSYLATTWLWTLNPSLAYVGQGIIMGPATTLHMLLGAVIGWGILSPLAKNRGWAPGDVDDWEKGSKGWIVWVSLAIMLADSVVSYRAINTNDAARGGLTRPRLGRRLSDISEASNSEDDEDAYTHLNSGLRQRHSSRLNRIQEDLGEEKEEEFDDAPPDQQVGDKTVAVGLVLSIIFCIGCIHLVFGNLVPLYATVTAVFMALVLSIMGVRALGETDLNPVSGISKLAQLFFAFIIPQSNKNSVLINLVAGAVSEAGALQAGDLMQDLKTGHLLGAAPKAQFYGQVIGATVGAIVSAFIYKLYTVVYTIPGPLFQVPTGYVWIFTARLVTGEGLPPMAKEWAIGSAALFAVTTAARIILVDKVGADKGKRWQALIPGGIAVAVGMYNVPSFTIARTIGGLLGWWWKGVMGWQDTPLIVLASGFILGEGFLSIVNLIMQSAGVPHL

SEQ ID NO: 27176 - protein, 284 aa, Escherichia coli
AGKPTDKPNLVCGPVQISWHKFARYWDVELREIPMRPGQLFMDPKRMIEACDENTIGVVPNFGVTYTGNYEFPQPLHDALDKFQADTGIDIDMHIDAASGGFLAPFVAPDIVWDFRLPRVKSISASGHKFGLAPLGCGWVIWRDEEAVPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEM

SEQ ID NO: 27177 - protein, 509 aa, Mus musculus
MPSGFQQIGSDDGEPPRQRVTGTLVLAVFSAVLGSLQFGYNIGVINAPQKVIEQSYNATWLGRQGPGGPDSIPQGTLTTLWALSVAIFSVGGMISSFLIGIISQWLGRKRAMLANNVLAVLGGALMGLANAAASYEILILGRFLIGAYSGLTSGLVPMYVGEIAPTHLRGALGTLNQLAIVIGILVAQVLGLESMLGTATLWPLLLALTVLPALLQLILLPFCPESPRYLYIIRNLEGPARKSLKRLTGWADVSDALAELKDEKRKLERERPMSLLQLLGSRTHRQPLIIAVVLQLSQQLSGINAVFYYSTSIFESAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTCNFIVGMGFQYVADAMGPYVFLLFAVLLLGFFIFTFLKVPETRGRTFDQISAAFRRTPSLLEQEVKPSTELEYLGPDEND

SEQ ID NO: 27178 - protein, 917 aa, Pseudomonas fluorescens
MLKKLGIKGRVLLLTLLPTSLMALVLGGYFTWMQLSDLQTQLLQRGEMIAEQLASLVAPAMGNHNTQMLERIATQALEQQDVRAVSLLAPDRSLLAHAGPSMLNPPPAGNSSHMMQRSGSDATRYQLPVFGRHRNLAGDLIPDESDRLLGWVELDLSHSGMLLRGYRNLFASLLLIPAGLAVTALLAVRMGRTINNPLTQIKQAVAQLKDGNLETRLPPLGSQELDELASGINRMASTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLNLPKTRDDAEDLPGPPLLGRRVAVLENHELARQALQHQLEDCGLEVTPFNTLEALTNGITGVHQSEQAIDLAVLGITTNDMSPERLSQHIWDLEHLGCKVLVLCPTTEQTLFHLSVPNPHSQLQAKPACTRKLRRALSDLVTPRRARSEPEETLSSRAPRVLCVDDNPANLLLIQTLLEDMGAKVLAVDNGYAALNAIQTEPFDLVMMDVQMPGMDGRKSTEAIRQWESERHGTPLPIVALTAHAMANEKRALLQSGMDDYLTKPISERQLAQVVLKWTGLALRNQGPERASERPELGLELQVLDQDEGLRLAAGKADLAADMLAMLLASLDADREAIKAARAANDQNALIERVHRLHGATRYCGVPQLRAACQRSETLLKQEDAKAFAALDELDHAIGRLAAEARTNA

SEQ ID NO: 27179 - protein, 184 aa, Leishmania major
AGGIAEMSHMGHEIREITDALDAAGNTTAAIGKGFAIGSAALVALALYGAYVSRVAIPVVNILDSCVMPGLLFGAMLPYWFSAMTMKSVGVAAMDMVNEIRRQFQDPEVAEGRKEPDYESCVAIATKAALNQMIPPAALVMMTPIVIGILFGKYTLAGLLPGAIVSGVQMAISASNTGGAWDNA

SEQ ID NO: 27180 - protein, 1211 aa, Homo sapiens [sequence omitted]

SEQ ID NO: 27181 - protein, 331 aa, Triticum turgidum
MTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGAKLLRAIAGAGVLSGYDQLQILFFGKKYGSGGA

SEQ ID NO: 27182 - protein, 193 aa, Myxococcus xanthus
MVTANLRFVVKVAYEYRSYGIKMSDLIQEGNIGLMKAVQKFDPDKGIRLISYAVWWIRAYIQNYILKSWSLVKLGTTQAHGKLFFSLARTRRELEKFGSGDAAVNVDDIARRLHVKPGEVREMEQRMGGRDLSLDAPMGEDGGNSHVDFVVSAAAPQDDEFADKEEAGLINARVRAALMRLDPREPSSSSNAS

SEQ ID NO: 27183 - protein, 424 aa, Gallus gallus
MASKEVLEDTVEERVISEEYKIWKKNTPFLYDLVMTHALEWPSLTVQWLPDVSRPEGKDYALHWLVLGTHTSDEQNHLVVARVQIPNDDQFDTSQYDSEKGEFGGFGSVTGKIETEIKINHEGEVNRARYMPQNPYIIATKTPSADVLVFDYTKHPSKPDPSGECNPDLRLRGHQKEGYGLSWNSNLKGHLLSASDDHTVCLWDISAGPKEGKIVDAKAIFTGHSAVVEDVAWHLLHESLFGSVADDQKLMIWDTRSNTTSKPSHSVDAHTAEVNCLSFNPYSEFILATGSADKTVALWDLRNLKLKLHSFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEEPDIAAAELEGQGT

SEQ ID NO: 27184 - protein, 333 aa, Mus musculus
LREDGEKAAREVKLLLLGAGESGKSTIVKQMKIIHEDGYSEEECRQYRAVVYSNTIQSIIAIVKAMGNLQIDFADPQRADDARQLFALSCAAEEQGMLPEDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITQSSLTICFPEYTGANKYDEAASYIQSKFEDLNKRKDTKEIYTHFTCATDTKNVQFVFDAVTDVIIKNNLKDCGLF

SEQ ID NO: 27185 - protein, 547 aa, Pseudomonas stutzeri
MSHILRAAVLAAMLLPLPSMADQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNARSPTGSTPERQSRPAWREVAVTFVDNHDTGYSPGQNGGQHHWALQDGLIRQAYAYILTSPGTPVVYWSHMYDWGYGDFIRQLIQVRRAAGVRADSAISFHSGYSGLVATVSGSQQTLVVALNSDLGNPGQVASGSFSEAVNASNGQVRVWRSGTGSGGGEPGALVSVSFRCDNGATQMGDSVYAVGNVSQLGNWSPAAALRLTDTSGYPTWKGSIALPAGQNEEWKCLIRNEANATQVRQWQGGANNSLTPSEGATTVGRL

SEQ ID NO: 27186 - protein, 160 aa, Hordeum vulgare subsp. vulgare
MKGAKSKGAAKADTKLAVKSKGAEKPAAKGKKGKAGKDPNKPKRAPSAFFVFMGEFREEFKQKNPKNKSVAAVGKAAGERWKSLSESEKAPFVAKANKLKGEYNKAIASYNKGESTTAAPKKASSKEVEEEDEEESDKSKSEINDDDDDEGSDEAEDAAE

SEQ ID NO: 27187 - protein, 168 aa, Gallus gallus
ILSNDLVINMLKSSFSTCVIVSEENKDAVIVEADRRGKYIVCIDPLDGSSNIDCLVSIGTIFGIYRKVSPDEPTGKDALQPGRNLVAAGYALYGSATMLVLATSAGGVNCFMLDPAIGEFILVDRDVKIKKKGNIYSLNEGYAKYFDAAVTEYLRKKKFPEDGSSPYG

SEQ ID NO: 27188 - protein, 166 aa, Gallus gallus
INMLQSSYSTCVLVTEENKEALITPKEKRGKYVVCFDPLDGSSNIDCLAPIGTIFAIYKKETDDEPSEKDALQPGRKIVAAGYALYGSATLVALSTGQGVDCFMLDPALGEFILVDRDVKIKKKGKIYSLNEGYAKYFDPAMTEYLKKKKFPEDGSSPYGARYVGS

SEQ ID NO: 27189 - protein, 161 aa, Esox lucius
IDCLASIGTIFAIYRKTTDNEPNEKDALQSGRHIVAAGYALYGSATMMVLSTGQGVNCFMLDPSIGEFILTDKNVKIKKRGKIYSLNEGYAQHFYPDVTDYLKKKKFPEDGSAPYGGRYVGSMVADVHRTLVYGGIFLYPANVKSPKGKLRLLYECNPMAF

SEQ ID NO: 27190 - protein, 173 aa, Xenopus laevis
VLSNDLVINMLKSSYGTCALVSEENKDVIIIPKDLRGKYIVCFDPLDGSSNIDCLASIGTIFAIYRKTTDTEPCEKDALQPGRNIVAAGYALYGSATLVALSTGQGVDCFMLDPALGEFVLVDKNVRIKKKGKIYSLNEGYAKYFDPAITEYLHNKKFPQDGSSPYSSRYVGS

SEQ ID NO: 27191 - protein, 505 aa, Cicer arietinum
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKASTLTSTLTARSKVASGVKTKTKEQIVDIDAADVTNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASHQVYAARCTLNKAPFWNETLQLHTGFSEPQLMDCAKLLVAFHKMAGDQKLKSIYRKYSNLERGAVALLSPAKSLFVFLIELLMNAIEKMQCSLFFTSEIWCRFLTCFGRNISPGCSLVLLQRNFLIPLILYAL

SEQ ID NO: 27192 - protein, 297 aa, Rattus norvegicus
MEDYIKIEKIGEGTYGVVYKGRHRTTGQIVAMKKIRLESEEEGVPSTAIREISLLKELRHPNIVSLQDVLMQDSRLYLIFEFLSMDLKKYLDSIPPGQFMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLVYDPAKRISGKMALKHPYFDDLDNQIKKM

SEQ ID NO: 27193 - protein, 801 aa, Rattus norvegicus
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPNVKSKPALLSGGLRMNKGAITPPRSSPANTCFPEVIHLKDIVCYLSLLERGRPEDKLEFMFRLYDTDGNGFLDSSELENIIGQMMHVAEYLEWDVTELNPILHEMMEEIDYDRDGTVSLEEWIQGGMTTIPLLVLLGLENNVKDDGQHVWRLKHFNKPAYCNLCLNMLIGVGKQGLCCSFCKYTVHERCARAPPSCIKTYVKSKKNTDVMHHYWVEGNCPTKCDKCHKTVKCYQGLTGLHCVWCQTTLHNKCASHLKPECDCGPLKDHILPPTTICPVVLTMPTAGTSVPEERQSTAKKEKGSSQQPNKVTDKNKMQRANSVTMDGQGLQITPIPGTHPLLVFVNPKSGGKQGERIYRKFQYLLNPRQVYSLSGNGPMPGLHFFRDVPDFRVLACGGDGTVGWILDCIEKANVVKHPPVAILPLGTGNDLARCLRWGGGYEGENLMKILKDIESSTEIMLDRWKFEVTPNDKDEKGDPVPYSIINNYFSIGVDASIAHRFHIMREKHPEKFNSRMKNKFWYFEFGTSETFSATCKKLHESVEIECDGVQIDLINISLQGIAILNIPSMHGGSNLWGESKKKRSHRRIEKKGSDKRPTLTDAKELKFASQDLSDQLLEVVGLEGAMEMGQIYTGLKSAGRRLAQCSSVVIRTSKSLPMQIDGEPWMQTPCTIKITHKNQAPMLMGPPPKTGLFCSLIKRTRNRSKE

SEQ ID NO: 27194 - protein, 564 aa, Mus musculus
MEGDQRSGPPAQSLLPDGHLVLWTLCSVLLPVFITLWCSLQRSRRQLHRRDIFRKSKHCWRDTDLFSHPTYCCVCAQHILQGAFCDCCGLRVDEGCLKKVDKRFPCKEIMLKNDKAADAMPHHWIRGNVPLCSYCVFCRQQCGSQPKLCDYRCIWCQKTVHDECMRGSLRSEKCDFGEFRNLIIPPSYLTSINQMRKDKNTNYEGLASKFGKQWTPLIILANSRSGTNMGEGLLGEFKILLNPVQVFDVTKTPPIKALQLCTLLPYYSVRVLVCGGDGTVGWVLDAIDEMKIKGQEKYIPEVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQECKDLNKKIELELDGERVELPNLEGIIVLNIGYWGGGCRLWEGMGDETYPLARHDDGLLEIVGVYGSFHCAQIQVKLANPFRIGQAHTVRLTLKCSMMPMQVDGEPWAQGPCTVTITHKTHALMLYFSGEQSDDDISSPSDHEDVKEAE

SEQ ID NO: 27195 - protein, 338 aa, Mus musculus
MANHAPFETDISTLTRFVMEQGRKAQGTGELTQLLNSLCTAIKAISSAVRQAGIAQLYGIAGSTNVTGDQVKKLDILSNDLVINMLKSSYATCVLVSEENTNAIIIEPEKRGKYVVCFDPLDGSSNIDCLVSIGTIFGIYRKKSTDEPSEKDALQPGRDLVAAGYALYGSATMLVLAMDCGVNCFMLDPSIGEFIMVDRDVKMKKKGNIYSLNEGYAKDFDPAINEYLQRKKFPPDGSAPYGARYVGSMVADIHRTLVYGGIFLYPANKKSPSGKLRLLYECNPIAYVMEKAGGLATTGDKDILDIVPTEIHQKAPVVMGSSEDVQEFLEIYRKHKAK

SEQ ID NO: 27196 - protein, 692 aa, Homo sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 27197 - protein, 477 aa, Mus musculus
MSPEDPQETQPLLRPPEARTPRGRRVFLASFAAALGPLSFGFALGYSSPAIPSLRRTAPPALRLGDNAASWFGAVVTLGAAAGGILGGWLLDRAGRKLSLLLCTVPFVTGFAVITAARDVWMLLGGRLLTGLACGVASLVAPVYISEIAYPAVRGLLGSCVQLMVVTGILLAYVAGWVLEWRWLAVLGCVPPTLMLLLMCYMPETPRFLLTQHQYQEAMAALRFLWGSEEGWEEPPVGAEHQGFQLALLRRPGIYKPLIIGISLMVFQQLSGVNAIMFYANSIFEEAKFKDSSLASVTVGIIQVLFTAVAALIMDRAGRRLLLALSGVIMVFSMSAFGTYFKLTQSLPSNSSHVGLVPIAAEPVDVQVGLAWLAVGSMCLFIAGFAVGWGPIPWLLMSEIFPLHVKGVATGICVLTNWFMAFLVTKEFSSVMEMLRPYGAFWLTAAFCALSVLFTLTVVPETKGRTLEQVTAHFEGR

SEQ ID NO: 27198 - protein, 394 aa, Rattus norvegicus
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPNFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 27199 - protein, 366 aa, Rattus norvegicus
MSLIRKRGFYKQDINKTAWELPKTYLAPAHVGSGAYGAVCSAIDKRTGEKVAIKKLSRPFQSEIFAKRAYRELLLLKHMHHENVIGLLDVYTPATSVRNFQDFYLVMPFMQTDLQKIMGMEFSEEKVQYLVYQMLKGLKYIHSAGIVHRDLKPGNLAVNEDCELKILDFGLARHTDAEMTGYVVTRWYRAPEVILSWMHYNQTVDIWSVGCIMAEMLTGKTLFKGKDYLDQLTQILKVTGVPGAEFVQKLKDKAAKSYIQSLPQSPKKDFTQLFPRASPQAVDLLDKMLELDVDKRLTAAQALAHPLFEPLRDPEEETEAQQPFDDALERENLSVDEWKQHIYKEIANFSPIARKDSRRRSGMKLQ

SEQ ID NO: 27200 - protein, 180 aa, Mus musculus [sequence omitted]

SEQ ID NO: 27201 - protein, 472 aa, Mus musculus
MATKCTKCGPGYPTPLEAMKGPREEIVYLPCIYRNTGTEAPDYLATVDVDPKSPQYSQVIHRLPMPYLKDELHHSGWNTCSSCFGDSTKSRNKLILPGLMSSRIYVVDVGSEPRAPKLHKVIEASEIQAKCNVSNTHTSHCLASGEVMVNTLGDLQGNGKGSFVLLDGETFEVKGTWEKPGGASPMGYDFWYQPRHNVMVSTEWAAPNVFKDGFNPAHVEAGLYGSRIFVWDWQRHEIIQTLQMTDGLIPLEIRFLHDPSATQGFVGCALSSNIQRFYKNEEGTWSVEKVIQVPSKKVKGWMLPEMPGLITDILLSLDDRFLYFSNWLHGDIRQYDISNPQKPRLTGQIFLGGSIVRGGSVQVLEDQELTCQPEPLVVKGKRIPGGPQMIQLSLDGKRLYATTSLYSDWDKQFYPDLIREGSVMLQVDVDTVNGGLKLNPNFLVDFGKEPLGPALAHELRYPGGDCSSDIWI

SEQ ID NO: 27202 - protein, 236 aa, Rattus norvegicus
MNIFDRKINFDALLKFSHITPSTQQHLKKVYASFALCMFVAAAGAYVHVVTRFIQAGLLSALGALALMICLMATPHSHETEQKRLGLLAVAFLTGVGLGPALELCIAINPSILPTAFMGTAMIFTCFSLSALYARRRSYLFLGGILMSAMSLMFVSSLGNLFFGSIWLFQANLYMGLLVMCGFVLFDTQLIIEKAEHGDKDYIWHCIDLFLDFVTLFRKLMLILAFNEKDKKKEKK

SEQ ID NO: 27203 - protein, 246 aa, Rattus norvegicus
MTMDKSELVQKAKLAEQAERYDDMAAAMKAVTEQGHELSNEERNLLSVAYKNVVGARRSSWRVISSIEQKTERNEKKQQMGKEYREKIEAELQDICSDVLELLDKYLILNATHAESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 27204 - protein, 247 aa, Rattus norvegicus
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 27205 - protein, 293 aa, Zea diploperennis
IIESVGEGVTDVAPGDHVLPVFTGECKECAHCKSAESNMCDLLRINTDRGVMISDGKSRFSINGKPIYHFVGTSTFSEYTVMHVGCVAKINPQAPLDKVCVLSCGISTGLGASINVAKPPKVSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTRPMNFLNERTLKGTFFGNYKPRTDLPNVVELYMKKELEVEKFITHSVPFAEINKAFDLMA

SEQ ID NO: 27206 - protein, 111 aa, Bradyrhizobium japonicum
MKKIEAIIKPFKLDEVRSLSGVGLQGITVTEAKGFGRQKGHTDLYRGAEYIVDFLPKVKIEIVIGDDLVERAIDAIRRAAQTGRIGDGKIFVSNIEEAIRIRTGESGLDAI

SEQ ID NO: 27207 - protein, 338 aa, Acinetobacter calcoaceticus
MSNHQVALQFEDGVTRFICIAQGETLSDAAYRQQINIPMDCREGECGTCRAFCESGNYDMPEDNYIEDALTPEEAQQGYVLACQCRPTSDAVFQIQASSEVCKTKIHHFEGTLARVENLSDSTITFDIQLDDGQPDIHFLAGQYVNVTLPGTTETRSYSFSSQPGNRLTGFVVRNVPQGKMSEYLSVQAKAGDKMSFTGPFGSFYLRDVKRPVLMLAGGTGIAPFLSMLQVLEQKGSEHPVRLVFGVTQDCDLVALEQLDALQQKLPWFEYRTVVAHAESQHERKGYVTGHIEYDWLNGGEVDVYLCGPVPMVEAVRSWLDTQGIQPANFLFEKFSAN

SEQ ID NO: 27208 - protein, 585 aa, Oryza sativa (japonica cultivar-group)
MERVAAAKKFIENHYRSQMKNIQERKERRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEMDNAPTRTGSGPSRKMMLNSKDLSFVGYTYKNFDAVKGLKHSDCFMKKEHRRTNKGATNSTAGRDVRKNAKCEDARIARCGCENVRWLPNDSRHVHARLDLATEAIARVLDSAFIQKATLKKKLVYSYLYYIKNSELRRWLADNKFDWRMAIDDVLVPLRMDHICNSQSHRK

SEQ ID NO: 27209 - protein, 590 aa, Nicotiana plumbaginifolia
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSTLLYNIDDIPGDGNKKAKQRLPHSKEFRFLDKAAIKVQDTESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFVSSILVTIVHKVTVKNPWLADNLNQGRLYDFYWLLATLSVLNLMVFLFISRRYVYKEKRLAECGIEMEDSEPACH

SEQ ID NO: 27210 - protein, 594 aa, Nicotiana plumbaginifolia
MALPETQQDSKALPDAWDYKGRPALRSSSGGWASGAMILGVEAVERLTTLGIAVNLVTYLTGTMHLGNATAANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDGDKKEKGQMIKFFDWFFFFINVGSLGAVTVLVYIQDNLGREWGYGICACAIVIGLVVFLSGTRKYRFKKLVGSPLTQIASVIVAAWKKTHLELPSNSSLLFEIDNIFGEGNKKSKQKLPHSKEYRFLDKAAIKEDNDLESNGTKVVINKWKLATLTDVEEVKLLIRMLPTWATTIMFWTVYAQMTTFSVSKATTMDRHIGTFEIPPASLTVFFVGSILLTVIFYDRIIVPICRRFMNKPHGLTPLHRIFTGLVLSILAMIAAALTEVKRLKVAHLHGLTNDANATIPLTVFWLVPQFLLVGAGEAFTYIGQLDFFLRECPKGMKTMSTGLFLSTLALGFFVSSILVTIVHVVTGTKNPWLADNLNQGRLYDFYWLLAILSVFNLMFFLYSSRKYVYKEKRLAEMGIELEDDGPVCH

SEQ ID NO: 27211 - protein, 266 aa, Methanococcoides burtonii
SSDDVKKMDDYIDVQTALIFTKQNPFKLYKLLEKSKTPSPIKAGMVATSDIIVEKGPTSFPPGPILGDMQGAGIPAAIDGGKVVIKETKAVAKAGEVVSQKLAAMLTRLEIYPLEVGLDLRAVLEEGSIFTPDVLAIDEEQIFSNFVQAAQQAFNMSVNAAYPTAMNINTLLAKAASDSRNVAVNATVYEPGIMDILLGKAYSKMMAIASAASSNDDALDDELKEALGAASSAVSAVEEVVEEQEEVKEEEEEESDMASGLGALFG

SEQ ID NO: 27212 - protein, 806 aa, Anabaena variabilis
MSELMQAILDSEEKNDLRAFISELRLQDKNYLLRNDILNVYSEYCSKCQKSETSYKFSNLGKLIYYTQEIIQEDSNFCFIIRPNIAAQEVYRLTADLDVEPMTVQELLDLRDRLVNKFHPHEGDLLELDFGPFYDYTPTIRDPKNIGKGVQYLNRYLSSKLFQDSQQWLESLFNFLRLHNYNGIQLLINYQIQSQQQLSQQVKKALNFVSDRPHDEPYEQFRLQLQAMGFEPGWGNTASRVRDTLNILDELIDSPDPLTLEAFISRIPMIFRIVLVSAHGWFGQEGVLGRPDTGGQVVYVLDQAKNLEKQLQEDAILAGLEVLNVQPKVIIFTRLIPNSDGTLCNQRLEKVHGTENAWILRVPLREFNPKMTQNWISRFEFWPYLETFAIDSERELLAEFHGRPDLIVGNYTDGNLVAFLLARRMKVTQCNIAHALEKSKYLFSNLYWQDLEEKYHFSLQFTADLIAMNAANFVISSTYQEIVGTSDSVGQYESYKCFTMPELYHVVNGIELFSPKFNVVPPGVNENSYFPYTHTQDRIESDRDRLEEMLFTLEDSSQIFGKLDDPNKRPIFSMARLDRIKNLTGLAECFGKSKELQEHCNLILVAGKLRIEESEDNEERDEIVKLYRIIDEYNLHGKIRWLGVRLSKNDSGEIYRVICDRQGIFVQPALFEAFGLTILESMISGLPTFATQFGGPLEIIQDQINGFYINPTHLEETATKILDFVTKCEHNPNYWKIISEKAIDRVYSTYTWKIHTTKLLTLARIYGFWNFASKEKREDLLRYLESLFYLIYKPRAQQLLEQHKYR

SEQ ID NO: 27213 - protein, 458 aa, Peanut witches'-broom phytoplasma
MKKISFFSEPINPTLLPTDLSEREQEEINKLKKSWESSLGYLNEEKSVINEYQNKCDEYQAQLNSIQPQIENETKNLIKLKLTLEKLTKPKSKNSKLKIWKLLVKSAKSKFKIWKLLVKSAKSKFKLVNYKQPKENTKKCYLMLKNTEKNLKNDLKKVKNNIKIQLFLDLTSTNTSNWGIIKKELLFKMMQVKKKLHLLFNEFFRYVFNNQYSSHYGIKQLSNLRIVVSIAKKQSERGQYFLDLIHEGNMGLMKTVDKFDYTKGFKFSTYATWWIRQAITRAVADQSRTIRCPVHVSDILNKNFAFKSKLTQDLARKARKAENHEIAKAMNIETKKLMIYKWLKRNDFFRNIYSWWRWFFFRWFYKRSLRYFASWLYVTRNFKKTLEESLEEALTPREQLVLKMRYGILEGDNRVHTLEEVGAKLGVTRERIRQIETKALRKLRHPSRSNPLSFLKKD

SEQ ID NO: 27214 - protein, 248 aa, Thauera aromatica
MGIQNRVALITGSASGMGKQTALRFAEQGAAVVINDIDAEKVRATVDEFSARGHRVLGAVADIGNKAAVDGMVKQTIDAFGRIDILVNNAGMERAGALRKLSEADWDVTINVNLKGTFLCTQAVHGHMVENKHGRIVNIASRAWLGGAGQTPYSSAKAGVVGMTRALAIELGRAGITVNCVAPGLIHTPMWDELPEKDQQFLLSRQPTGKLGEPDDIANTLLFLADDDSGFVTGQVLYVCGGRSLFAG

SEQ ID NO: 27215 - protein, 1075 aa, Zea mays
  unsure (1)..(1075): unsure at all Xaa locations
MAANKGMVAGSHNRNEFVMIRHDGDVPGSAKPTKSANGQVCQICGDSVGVSATGDVFVACNECAFPVCRPCYEYERKEGNQCCPQCKTRYKRQKGSPRVHGDEDEEDVDDLDNEFNYKQGSGKGPEWQLQGDDADLSSSARHEPHHRIPRLTSGQQISGEIPDASPDRHSIRSPTSSYVDPSVPVPVRIVDPSKDLNSYGLNSVDWKERVESWRVKQDKNMMQVTNKYPEARGGDMEGTGSNGEXMQMVDDARLPLSRIVPISSNQLNLYRVVIILRLIILCFFFQYRVSHPVRDAYGLWLVSVICEVWFALSWLLDQFPKWYPINRETYLDRLALRYDREGEPSQLAPIDVFVSTVDPLKEPPLITANTVLSILSVDYPVDKVSCYVSDDGSAMLTFESLSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVIKSCCGRRKKKNKSYMDSQSRIMKRTESSAPIFNMEDIEEGIEGYEDERSVLMSQRKLEKRFGQSPIFIASTFMTQGGIPPSTNPASLLKEAIHVISCGYEDKTEWGKEIGWIYGSVTEDILTGFKMHARGWQSIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAAALGQCGVNC

SEQ ID NO: 27216 - protein, 1074 aa, Zea mays; identical to SEQ ID NO: 1025

SEQ ID NO: 27217 - protein, 538 aa, Oryza sativa (indica cultivar-group)
MARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGH

SEQ ID NO: 27218 - protein, 224 aa, Autographa californica nucleopolyhedrovirus
MWYIIVIIIIIIILNLFIIILLTLKILDDIQELYPNPPIVPPPTSPPIVPLPTPPPTPTPSPPSPTPPPTPIPPTPTPTPPPTPIPPTPTPTPPPSPIPPTPTPSPPPSPIPPTPTPSPPPSPIPPTPTPSPPPSPSPLGEPMYYPSNIDTNEALINFLRPLCATDRTRATYAVPWNCNGIFHCNYFSIPFYILSCHNNAYSFVNDGCIDFNSSDCPLYPLNVL

SEQ ID NO: 27219 - protein, 3247 aa, Bovine herpesvirus 1
MAFAPVARPQPGEARAGGAAGGLRINGAARAVPPSTPVEQRSGTMSGVAGARAPATPADVAVAAVGFRNQYDAALGPGSAVACLRSSLSFLRLAFAGGVDAALGADAIDGALAEGAAWARESGARPEMCSIVHLPNRITDQAGAGSGLCCVFSRVYGECGFYTPPAERALSTQVPAREFVDAVWQPRRTSLALVIVGAMGVGVFRAGDAVYLFDPHGSGDVPQAFVARMPPRALYAYLALRACGQPESRWAGALVHFVSAGPEPARPEELRAAVSALYGASETYLDDEPYVERRVVSVHPRAPANTACLTAVAVGGAGAECEDPTFARPGSPALLPAEPVARMPPQITAAAAARAAGKRTSLPRRRRAPWTPPSSREDLRAPAARARAGKPPRKVRGAETAGAGEDWGEGGNAAAARPPPALGAAAPAHAATACAAELGARAAEVTAALDAVQAHAASIAADADACVARAVRVARPRDAAAERDPLEHAIAGLFERVLAFLVQNGARTRHDAPSAVQPLFGAVAQALPQHTPASAFITSSGMVLEGLAAYTRLSEAMRAQPSALGDLADAKLRLVAAAVAADTERLHDAVDELEGEVDGAGGAGPLELCGAVSARFMERLSASGRRLFSRAALRDGRPLDARVRALFERARAREARVAAETAALAREILALEGTVRAARERLDAVPPDDPRAVPADSAVADLAAELAAGRAAVVARSAAALSAELDALAAEALRQYFLRGAQYSARAILADRGGGERFRVASAAVAPLQRLAGSAPDLAARVARLGAAPGAAAPPLPRSARKGELLRDLLAAGATAHTEDGLAAWVALLHEAQAEGAAAKKELDAVLSDVAAINGRSASRASLEASMARFEAMSAAAARAAAGAAAEAPGAGAEEAADAAEAAVRGADDVLRQLDALATGAAADREARARVAAARAGLEAQALAARRRVAELGERRAELYQRLDALLLPLQGFAGLRAAPGALERLCADAGAQSAEDCARFLQEAPPRVAAGVQDRLWQLFGRYREALENPSALAPGALAGLGPAFAAVLGTALGQAMGPAARAFFEGHAERVAAAVARAAAEPAAPAAVAAAASALREAAEALRAGGAHVPPEFAFLDALQAQYAARREAQTGARRLGAALAAVSEASGALASAASALKNAMTAGADAAETTAAAAAADAALGAAEEVLRAADEAAVAAGGEDADGGEDASEADADGAGDAPPAGRLGPQAAKLHADLRKARALARRRAEEVRRLRAEAERRAEGAAAQRQEERWREDLRAALERVEANSAFDAAELARLRAAAAARGYDPRPLARQADRALEASAQRATAAIEAVLAFNPHAPENAKIDVPPPLAQLRGIAWWDAFSLAAPALSALFPAADVGQLTRLMHIATGLLTFAASGGGEPRYYDAVTYLEGDLAAVPRLAKYVAFYRRGHAAFEEERARLGALRADVLQAAGGRAAEISRARRGNVLRSPAERRALEAGVRLELPSEALIASALAQLERFDHARFAGSAYEAQMLSTVRRDAAAAREALEAAKAARAEATARAERILGEVVAAEAARDRDEGAGLANLKNLLRITPPPAALGPALDRAASAADVVTQAALLLAAVEEAPELDVAAVEWLQQARSIIDSHPLTARIDDRGPMEPFAERIDALRELRRHLDALRRQLESAAAAWDGAWELFVAARRRAAASREDHEGAKARAAALQAAAGVVLGLRADEHYARLPAAFTGALDARLAERGDALGAFHEAARAADAGLQRLQATLAAVRGEAAYEGLRALLAAFDAQVAELPAWAAQAHAPFRDLLVLRMRLYEAYFKLVPRAAARARGAAAARAARAAATVHSRADPATRAVAARAARLCERDLHLRGRVAALLGDEAAVCTLREADSEIDALAPRAYLDADGTPLCYRVCYRAVGDKLAVALCSQVGASMRPPLDESGVVEAASVAAVNVLNEIVNLRLEIERARDADFGAFCRFVRHRRADWGLADVRSAAAELYAGLLATTLPRRHGVASLGALCFSLAERGLRPARAPASGPAPSGGGALELTPADLVVAALMGAFMHLVNFTRLDLVQKQEYMCKTLDGVLTEALTSRVAVNSLAPGEPGARRPVPLGGGADDPADGALFAIRAADWDAGRLSPSDVLAVWRHAPDAATRATVAELARLIPGGALTTISVLARMCIPGDLLAALWTTLAVDSLGAQTQSYDAFLARRLDAPSTVHATGGPSEDAAALAAAAAAAGGRPALFCPTGSSVTFTLVRQPPSEVQTVNALDLVTCALLLGAPVVVAMENPDVFSEGSRLIMCLRLFDTRPGGRDADAPAAVSSDLNSWGERLLALDENIIENACLTAQLEQLSALIASKPLRSAPPCLIMLDTHLQLARVLWARAAAPPLAMLKIAEDDVLRDLPSLTLDYEDALPPAASAADPLFTHIISENNVPDFAAASGDPLYAHPPVFQHATDNLFPHARAAAGGGSGNRVANARAVAAAARPPTPASAPAPAPALAPASAEPALAWGADEWLDDEIGDAYPPAPAHDAYPPAPAHDAYPPAPAHAQGKPALLAAPAAGAAEAPGVERARRLTRRTGPRKSMPAALPWRRPPPASLVSAAPPVPPGPRLPPAPPLPPPAPPLPPPAPPLPPPAPPLPPPAPPLPPPAPPLPPPAPSTAPVPAPPLPPPALTPALTPAPTPAPTPAPPLPLPAPITVLVPAPVPAPAPIPAPAPTPAPAPTPAPPLPPPAPDGAMGALSATRRPTRRAGARKSLPAAQPRQRLLRSRSPASVPAPGSELVPPPSGGALGSPPSFVPSRPPSLEPVPGLPLPPSRVQAPVDAPAPPPAPERPAPPPAPERPAPPPAPERPAPPPAPERPAPPPAPERPAPPPAPERPATAVQSGSKIPAPSNALVGQVAPALLRRGPSPRGKPGAPARPTGGANIARKNTRAVDPTVIGSGSALSGLGSAEEDADFGASGMYVAPPGPAPLAAPPAPSALPAPRLEAPAAASLPAPPIAPPIAPPIAPPIAPPIAPPIAPPIAPPIAPPIAPPAMPAPPSAAPATAGSSAPPIAPPATPAPLIAPLAAPVPRLVGAAARGRVIGHMRAAAPKPRGLRAAERPPMRSWASRGNLHTQDLLASAEARICELPAPPKVPLGADSDATDSSLDGSGPETEEETEAEAGGDGPGQDAPKARVVPANSLLKRQYLRGTGISVLALLLEACEKIARRLRATRDVLRQRAAEVTADIFALRLLLG

SEQ ID NO: 27220 - protein, 864 aa, Lymantria dispar nucleopolyhedrovirus
MLTVSLLLAAIILVVIFLILYLIIYNDFDENEFDRRVKVTLEYMKRTNAEHPLPPVLAYVSHVDENIFALTQFDTNTMSALASSLHDDTVETFNFLKQSLEPVEHAHDAPRVRAHPGDRTKFSIRGDDGWLDVECPHGERFDEAAAKCAPVPVCENKPVGNYPLTARLIDRLVLNRRVAVVADEDDAAAAHPTMYLRCVAGGSHAVLECPENHTFDASSGRCVESAECENRPDGFLLNRFPSHLNADEYLECENGQTAVRRCAAGHIFDRRLLECVAGDPCRTHGAGHTYITADIGQAQYFLCVNASDAELVTCINRVFDGGQYRCAGDSRCAQFPDGTGVTVFESNDQTLKYDTGALACDEYEVVRHIECDARDQLLDRLFHDKFAVGVSLPRQVYDSARGECADFSLASPHVSVENERYAIQNAPNDVGVSFEVAFVGRTERVESLANSLEFPAASVVYARDANALGISFYDGAPVDCAAGPLLFDPFEGRRLNECDERADGEPSELIARVALKPNEYFSPKEGRVRSNADYEHDCARILDGAENYVAMDHFRTGKTVDILQSDACEVILRDLHNKYISQSRSAVRSPGKYTGKSVKRKKNIEVYGSNIRKRARVSTPGAKIPTAPLAKIPTPLFVPFETIPTAKPLFDPFAYEDADEDADEDKIDEVADEDEDEDKIDEDEDEDKIDEDEDEDEDEDEDEDEDEDEDQEIVVPPPDLTLSDKMIDFSCFYSVPTFETIACSAPDERVQSAWREAREAATVHPDCAAAAGLVNIVNAYAYLGEGVKCKSGFDAARGLFVDRVAAGPEFADLTTQSNDGVKYNRHVHARGGLFVACPEDLFDDDAFACRLKEDKIYFIQDLHE

SEQ ID NO: 27221 - protein, 151 aa, Paramecium bursaria Chlorella virus 1
MSIVFITSDFHRIEADKNVLDQSTVINDIVEDVGDDEPIPLPTITAKVLTKILEYCSFYNVSHTEREIKDFDKGFVNINMDFMFDLIQGANFLNIKGLLDVLCAAVADRIRGKTPEQIREVFGIENDLTPEEEAAALAEHSWTHLVPIEDY

SEQ ID NO: 27222 - protein, 544 aa, Paramecium bursaria Chlorella virus 1
MIGRVIFFLTLVTTAFARPEPFTTNQIVTTQTTVVNSPKPPSPKPPSPKPPSPKPPSPKPPSPKPPSPKPPSPKPPSPKPPSPKPPSPKPPSPKPPSPKPPSPKPPSPKPPSPKPPSPKPPSPKPPSPKPPSPKPPAPEPPAPEPPAPEPPAPEPPAPEPPAPEPPALEPPAPEPPAPEPPAPEPPAPEQNFYGKWTYNTLDVNARMNGRPFIPAIEFALPINKEDKVVIENRGTPLVFTTPGVIELNSSGIGTGDFITVTIKYETSSIDWTINEMNDYGVGIAFIRSDGEFFNVPHVWDDGDTGYDIVLRESQRRPMGRNIEHTKTIQIPEGPDRVEIALLPMFGWMNDGVHDFVQGSLTNVELSIEINVLTSPPAPPPPTPAPPPPTPEPTPEPAPQYEITAKFEDHPYLDYTQDNANVKPSYFNTKVVDVNIKYDVDGVFEIPFGCTNMTLKVNGFDLVTDRLRCIHISLRIYDDNDVVVQDVFKIPQSEICYNSPPRAFEYMVDITEQMKSIVFNIAVNPGYTLNDPVVIESMELIFSNI

SEQ ID NO: 27223 - protein, 372 aa, Paramecium bursaria Chlorella virus 1
MNSVVNNILKAHPHQTKSFYVSSPKIVEDLIDQWTILFPRVTPHYAVKCNNDEVLLKTMCDKNVNFDCASSSEIKKVIQIGVSPSRIIFAHTMKTIDDLIFAKDQGVDIATFDSSFELDKIHTYHPNCKMILRIRCDDPNATVQLGNKFGANEDEIRHLLEYAKQLDIEVIGISFHVGSGSRNPEAYYRAIKSSKEAFNEAISVGHKPYILDIGGGLHADIDEGELSTYMSDYINDAIKDFFPEDTVTIVAEPGRFFAEHYSVLATQVIGKRVRDGLYEYFFNESTYGGFSNVIFEKSVPTPQLLRDVPDDEEYVPSVLYGCTCDGVDVINHNVALPELHIGDWVYFPSWGAYTNVLTTSFNGFGEYDVYYI

SEQ ID NO: 27224 - protein, 363 aa, Paramecium bursaria Chlorella virus 1
MILASIQPKVFIHRHAKSTAIGYPVTLNRDFKKVLPEMEHSLNNAGCPFEKTGTFDRARHDDERHLITRIAGMWNVDKDNIWGYTTSGGSEGNLEGLYIAREKYPDGVLYATDQIHYSIKKIAKLLRMKFVVIPSDDTGAMDICQFDSLVDKTKPAIVLANIGSTFVGGIDNVEQIHNSLKRNGMNFYIHADAAFYGFVMKYLRPGFDDYVFYDSISVSCHKFPGLPFPGGIFMCVKKHVEHIDNFEEVIRQRDITISGSRNGHTGIFMNYFFDTIDLEKEVEDCLERTEYLFERLREAVPECMPWKNDRSVIVVFKKPSDEIIFKWSLATVKGRSHAIVLNHVTTDIIDAFVHDMAMYFGRR

SEQ ID NO: 27225 - protein, 183 aa, Fowlpox virus
MSRIKILIGITGSVAAVKLPDLIKELTRLENIELRIVATENSMKFTDQKTIGIPIYTDKDEWTTWKKIPDPVLHIELRRWADVFIIAPLTANTLAKIANGICDNLLTSIVRAWDTNKPLIFCPAMNTLMWEHPITEKHIDTLKYMGFIEIECIEKKLACGDVGNGAMAEVAEIYRVVRDIMRV

SEQ ID NO: 27226 - protein, 353 aa, Apis mellifera carnica
MGNNAATANKKVDAAESVKEFLDKAKKEFEDKWKRNPTNTAGLDDFERIKTLGTGSFGRVMIVQHKPTGEYYAMKILDKQKVVKLKQVEHTLNEKRILQAISFPFLVSLRFHFKDNSYLYMVLEYVPGGEMFSHLRKVGRFSEPHSRFYAAQIVLAFEYLHYLDLIYRDLKPENLLIDSQGYLKVTDFGFAKRVQGRTWTLCGTPEYLAPEIILSKGYNKAVDWWALGVLVYEMAAGYPPFFADQPIQIYEKIVSGKPRFPSHFGSDLKDLLRNLLQVDLTKRYGNLKAGVNDIKGHKWFASTDWIAVFQKKIEAPFIPKCKGPGDTSNFDDYEEETLRISLTEKCAKEFAEF

SEQ ID NO: 27227 - protein, 385 aa, Populus tremula x Populus tremuloides
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 27228 - protein, 57 aa, Cryptomeria japonica
LHCLDNEQSNHLRRIYKERGENVGAWRQACYYPLVAIARENNWDIEGVFNRNEKLKI

SEQ ID NO: 27229 - protein, 491 aa, Pseudomonas sp.
MKQYRNFVDGKWVESSKTFQDVTPIDGSVVAVVHEADRDLVDAAVKAGHRALEGEWGRTTAAQRVDWLRRIANEMERRQQDFLDAEMADTGKPLSMAATIDIPRGIANFRNFADILATAPVDSHRLDLPDGAYALNYAARKPLGVVGVISPWNLPLLLLTWKVAPALACGNAVVVKPSEDTPGTATLLAEVMEAVGIPPGVFNLVHGFGPNSAGEFISQHPDISAITFTGESKTGSTIMRAAAEGVKPVSFELGGKNAAVIFADCDFEKMLDGMMRALFLNSGQVCLCSERVYVERPIFDRFCVALAERIKALKVDWPHETDTQMGPLISSKHRDKVLSYFELARQEGATFLAGGGVPRFGDERDNGAWVEPTVIAGLSDDARVVREEIFGPICHVTPFDSESEVIRRANDTRYGLAATIWTTNLSRAHRVSELMRVGISWVNTWFLRDLRTPFGGAGLSGIGREGGMHSLNFYSELTNVCVRIDKESPDV

SEQ ID NO: 27230 - protein, 469 aa, Caenorhabditis elegans
MEISQYTKDKASCTRISIESYYSKRVTQCAERENRLKKLEEDISARGLSDEEKEEKRKIHHSKETDYLRLKRTRLTVNDFESLKVIGRGAFGEVRLVQKHDTGHIYAMKILRKSEMVEKEQTAHVRAERDILSEADCDWVVKMYYSFQDYSNLYLVMEFLPGGDMMTLLIKKDTLTEEATQFYIAEAALAIQFIHSLGFIHRDIKPDNLLLDARGHVKLSDFGLCTGLKKFHRTDHYRNWPSTLPPDFISKPFESKRKAETWKRNRRAYAYSTVGTPDYIAPEVFQPNGYTKSCDWWSLGVIMYEMLIGYPPFCSELPQETYRKVINWQQTLVFPSDVPISIEAKATIKRFCCEAERRLGNHGGLDEIKQCPFVKRIDWNHIRERPPPIRVTVKSIDDTSNFDDFPDEDLTWPTSTLIRPEEQPGRRGEFVDFTYKRFDGLTQKMRYSDLKKFQQAKKNKKGGQQGTSD

SEQ ID NO: 27231 - protein, 153 aa, Mesembryanthemum crystallinum
PPIIFNAGFQVKKKQFFKNFSFILMFGVLGTIISFCLISSGAVLLLKKIGLTQLNLNDYLALGAIFSATDSVCTLQVLNQDETPLLYSIVFGEGVVNDATSIVLFNAVQSLDLSNLSSMTALALLGTFLYLFFTSTILGILVGLLSAYVIKKL

SEQ ID NO: 27232 - protein, 140 aa, Mesembryanthemum crystallinum
KKQFFRNFITIIVFGALGTLVSFTIISLGAMEFFKKLDIGSLELGDYLAIGAIFAATDSVCTLQVLHQDETPLLYSLVFGEGVVNDATSVVLFNAIQNFDLTHIDHRIAFKFAGNFLYLFFTSTLLGAITGLLSAYIIKK

SEQ ID NO: 27233 - protein, 921 aa, Yarrowia lipolytica
MSQFSQAFLNPGPAPPPPKPFASSLTASSSGTNLSGLMTPTEPRTAPTITRDAITRPASSNRVLKSGFASVKEDGSSFRSLMWTKKYLVLRENALDFQKSETSSVQFSIPLYTVSNVTRVDLKPYCFEIVRSSGFKSVFVVCKNDTELYAWIDEIYSKCPLMGVSNPTNFTHKVHVGFDPISGGFTGLPDAWSKLLSTSAITKEDYAKNPQAVIEVLEFYSKENVEAMGFNASSLGIGIENKFDEGLTMDAARVRAMQQQQKQQQAQRMANNLQEWTKPVPSTGSSSSSTATTPARYNATRKNDDDLLTSLSPSTSVPRRPSVPNVTRAAPPRPERPDGLPSTSTIPRDRSELRQELRNEMRAGAGNSSGSVSGASGSGTQTPVHPLLRINPDVDSYQQRQSPTSNTGGNYPTTPTSMTQSSSQGSLSSKTSPTAYRASPVATAALHDLPPPQRPMLRHKNSSGSINSVSSGNSYVAPLMVKKAIPANRPPQTAPPVPAQSGGDKFQPQRAAPVPQQTQQPQALPASSGTSAAPALGAANQFKPQRPAPSPQKTTPKTSPKKPSAAGVGQGGYPRMSPTKTSPTKTSPGGASAAAAAAAAAATTAALEGPKKKPQHDERRISTMTDAQITEKLKSVVNPQDPTPLYQKLKKVGQGASGSVYVARPMTNEFQLKKVAIKQMDLASQPRKELIVNEIIVMKESQHANIVNFLDAYLRGTNDLWVVMEYMEGGALTDIIDNNSLSEEQIATISGETCKGLQHLHHQNIIHRDIKSDNVLLDYQGHVKITDFGFCAKLTDQKNKRATMVGTPYWMAPEVVKQKEYGAKVDVWSLGIMAIEMIESEPPYLNEEPLKALYLIATNGTPKLKHPERLSKDIKAFLSVCLCVDVNYRASTDELVNHEFLKKGCGLQSLSPLLAYKHKKI

SEQ ID NO: 27234 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYVHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 27235 - protein, 96 aa, Gallus gallus
QNVADYMRYLMEEDEDAYKKQFSQYIKNNITPDGMEEMYKKAHAAIRDNPVHEKKPKREVKKKRVNSTKMSLAQKKDRVAQKKASFLRAQERAADS

SEQ ID NO: 27236 - protein, 504 aa, Drosophila melanogaster
MAKMPETTFADLSLADKTAVKKSSIEARRFSDVSTCSFSSTCFTGSSDEEDVSPKDNHQRNSAGGTDFCVKSISKSAFGRREIEIAESEMPGIMTLRKRAKDEKPLKGANIVGCTHVNAQSAVLIETLVQLGATVRWAACNIYSTQNAVAAALAEAGIPIFAWRGETEEEFWWCLDRAIYSDGWQPNLILDDGGDATHLMLKKYPDYFKAIRGIVEESVTGVHRLYMLSKGGKLTVPAINVNDSVTKNKFDTFYTCRDSILDSLKRTTDIMFGGKQVVICGYGDVGKGCAQSLKGQGCIVYVTEVDPICALQAAMDGFRVVRLNEVIRTVDVVVTATGNKNVITRDHMNRMKNGCILCNMGHSCSEIDVNGLHTPELTWERVRSQVDHIRWPDGRMIILLAEGRLVNLSCSTISSFVVSVASSTQALALIELFSAPGRYKSDVYLLPKKMDEYVASLHLATFDAHLTELTDEQSKFMGLNKAGPFKANYYRLVTLLSLSILHSS

SEQ ID NO: 27237 - protein, 336 aa, Shigella flexneri
MRRELAIEFSRVTESAALAGYKWLGRGDKNTADGAAVNAMRIMLNQVNIDGTIVIGEGEIDEAPMLYIGEKVGTGRGDAVDIAVDPIEGTRMTAMGQANALAVLAVGDKGCFLNAPDMYMEKLIVGPGAKGTIDLNLPLADNLRNVAAALGKPLSELTVTILAKPRHDAVIAEMQQLGVRVFAIPDGDVAASILTCMPDSEVDVLYGIGGAPEGGVSAAVIRALDGDMNGRLLARHDVKGDNEENRRIGEQELARCKAMGIEAGKVLRLGDMARSDNVIFSATGITKGDLLEGISRKGNIATTETLLIRGKSRTIRRIQSIHYLDRKDPEMQVHIL

SEQ ID NO: 27238 - protein, 339 aa, Hordeum vulgare subsp. vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGERYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLRSIEHRAMTNSVLARTSVATFIMPTQECLIGPAKEFLSEENPPCYRTIMFRDFMRIYNVVKLGSSLNLTTNLKNVQKEI

SEQ ID NO: 27239 - protein, 1070 aa, Emericella nidulans
MRVPIAVQLGLLVLLTALAGLAALAIATWINNYNFVVDVKSQSLQLVASIKSSQITSNLDLLETTSKTIITRILIQSALQRYYAGNTTEENFASSITDVQSALGSRGYLSLYQASIYARNVENGESKARRLLNVTSDEVPEIRLPYDHPNGTAVMLGDEGLGYPPSLYPNLTEDATTNKLYAFDGVPITTNQPLLLGPLATNDSFSLISLSLPIINNTSAADILGYITVVASAANLQDAMSSRQGLGSSGQVLLLAPSRPENRFPTGSRPATATSEPQIAGLDNQEVRYVFRPTPLPGNKRRHSPAVASGASFPLRDYPIALKVLNQPYDSINHSITDLSSKNENGTRVAVGAIQQRSDLVEWVLIIEETHGEAFAPVSRLRKIILACVFGTAGVIALLIPPLAHLSVAPIRRLREATRKSVNPTIGPLSPSLSTMVDPIEISMHNGNEKSEKGGFFNRLKRGRGNLATGHDRDNEPHQFQIPGRVKERKHIITDELTDLTKTFNEMSDELVIQYNRLEERVAERTRELEKAKIAAETANESKTLFIANISHELKTPLNGILGMCAVCMGEDDLPRIKRSLQTVYKSGDLLLHLLNDLLTFSRNQIDQAIRLEEKEFKLSDIRSQLQIIFQNQVQEKQISFSIKFCHPDTPPINDTPEVISRAPGPVYGPPGTAKLKDMVLWGDQHRILQILINLVGNSLKFTPEQGTVAIRIKCVGEEKNPSASPRPESRALSRWRSIGSSHASSRPKTSLDRPRDGGDEETTRPPNLRTLILQFEVEDTGPGIPQHLQNRVFEPFVQGDLRLNRKYGGTGLGLSICSQLARLMRGQIQLNSEQGRGTLFLVRIPLGFVKESPPSTASSMTSLAGSRTSSVFSLDDLASVTKAPSNHSVASQHESTKSNAEIQDSQPRLVGLSQPFFAPPVPQAKDNGLKKIRALVAEDNVVNQEVVLRMLALEDVYDVTVVKDGQEAYDTVKANMEEGKVFDLIFMDIQMPNLDGIESTRLIRQMGCSAPIVALSAFSEDSNIKDCMNSGMDMFISKPIRRPALKQVLRRFTPIPEEAEKPRDVNFAL

SEQ ID NO: 27240 - protein, 181 aa, Oryza sativa (japonica cultivar-group); identical to SEQ ID NO: 3387

SEQ ID NO: 27241 - protein, 1136 aa, Tuber borchii
MADKLLQDVYRKIEREKVLINGARAMRQSTDNAAVQQKLDNQIRESQRNLSYLEGRYGELQNMVITSGVGDMHVNDGGGYGGGYQNPQMLPPNKPFAQGSGGSAQPKTRPNYSKLDLIKYDTPHLGPRIQLMLSQLEFKLSVEKQYKEGIEKMIKLYQMEGDRKSRQDAESKHTDIGQKIQLLKQALKRYEDLHVDMDFGDEDSINSPNIRRPLTGRLAIRVLAVKDVDHATTSRFARGPETFVIIKVEDVARVRTKFTRNDKWLDEAHDIDVDKANEIEMTVYDKPGDNHMPIGLLWIRISDIAEELRRKKIEQEISSSGWVSADKMANSGAGRPGEGAYNYSQGFGGPAAAGGGNTGMYVNNSGQAQAQGGSAGIDAWFALEPVGQIHLNLNFVKYNRNKRPLDLGLGRKGAVRARKEEVHEMYGHKFVQQQFYNIMRCALCSDFLKYSAGMQCSDCKYTCHKKCYPKVVTKCISKSNAETDPEEEKLNHRIPHRFEPMTNMGANWCCHCGYMLPVGKKNARKCTECGLTCHSQCAHLVPDFCGMSMEVANQILGEIKKTKKRGPSMTDRNLRTNVPPVPSSPLSGRPTSDPYVSALDPRNSVQGEPAQLSQRTHSYTPSSPTAVNAANVAYGTASSPARPQQPAPYSPEQRPNRVPEPTAVAAAAHAGQRPPSTVQSQTGYPPRQSADFYQGAPTSPTQPNHPTELPSSPSPYQQGQGYDNPYQQHHAPTPQQPPAAPPKASPAPSGYGQPQATQYDQRQSYGQPPPAPAKVAPPAHTPAAEKQPPPPPVLEPQHVVSRPTKIGLDHFNFLAVLGKGNFGKVMLAETKASKKLYAIKVLKKEFIIENDEVESTRSEKRVFLIANKERHPFLLNLHACFQTETRVYFVMEYISGGDLMLHIQRGPFGSRRAQFYAAEVCLALKYFHENGVIYRDLKLDNILLTLDGHIKIADYGLCKEEMWYGSTTSTFCGTPEFMAPEILMDKRYGRAVDWWAFGVLIYQMLLQQSPFRGEDEDEIYDAILADEALYPIHMPRDSVSILQKLLTKEPELRLGSGPTDAQEIMSHPFFANINWEDIYHKRIPPPFKPSIQSATDTSNFDQEFTSVTPVLTPVQSVLTQAMQEEFRGFSYVQDFS

SEQ ID NO: 27242 - protein, 463 aa, Drosophila melanogaster
MMSSRTQDADGASIRFSDHTLDKATKAKVTLENYYSNLVTQYGERKQRLAKLEAQLKDESLSEAQRQEKRLQHAQKETEYLRLKRLRLGVEDFEALKVIGRGAFGEVRLVQKKDTGHVYAMKVLRKADMLEKEQVAHVRAERDVLVEADHQWVVKMYYSFQDPVNLYLIMEFLPGGDMMTLLMKKDTLSEEGTQFYISETALAIDSIHKLGFIHRDIKPDNLLLDARGHLKLSDFGLCTGLKKSHRTDFYRDLSQAKPSDFIGTCASLSCSPMDSKRRAESWKRNRRALAYSTVGTPDYIAPEVFLQTGYGPACDWWSLGVIMYEMLMGYPPFCSDNPQDTYRKVMNWRETLIFPPEIPISEEAKETIINFCCEADRRLGSQRGLEDLKSVPFFRGVDWEHIRERPAAIPVEVRSIDDTSNFDEFPDVSLEIPSAPIPQGGEIAKDWVFINYTYKRFEVRNLE

SEQ ID NO: 27243 - protein, 581 aa, Arabidopsis thaliana
MENLGFLIISTFLLLFTTLLPYSSASTTRRFHFNVEWKKVTRLCHTKQLLTVNGQYPGPTVAVHEGDIVEIKVTNRIAHNTTIHWHGLRQYRTGWADGPAYITQCPIRSKQSYTYRFKVEDQRGTLLWHAHHSWQRASVYGAFIIYPRQPYPFSGSHIQSEIPIILGEWWNDDVDNVEKAMMKTGAGAKVSDAYTLNGLPGPLYPCSTKDTFTATVDAGKTYILRIINAALNNELFVAVANHTLTVVEVDAVYTKPVHTKAIMIAPGQTTTLLLRADQLSGGEFLIAATPYVTSVFPFNNSTTVGFIRYTGKTKPENSVNTRRRRRLTAMSTVVALPNMLDTKFATKFSDSIKSLGSAKYPCKVPTKIDKRVITTISLNLQDCPLNQTCDGYAGKRFFASMNNISFVRPPISILESYYKKQSKGVFSLDFPEKPPNRFDFTGVDPVSENMNTEFGTKLFEVEFGSRLEIVFQGTSFLNIENHPLHVHGHNFFVVGRGFGNFDPEKDPKRYNLVDPPERNTFAVPTGGWAAIRINADNPGVWFIHCHLEQHTSWGLAMGFIVKDGPLPSQTLLPPPHDLPQC

SEQ ID NO: 27244 - protein, 164 aa, Arabidopsis thaliana
LKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 27245 - protein, 316 aa, Emericella nidulans
MAEQLVLRGTLEGHNGWVTSLATSLENPNMLLSGSRDKTLIIWNLTRDEQAYGYPKRSLEGHSHIVSDCVISSDGAYALSASWDKSLRLWELSSGQTTRTFVGHTNDVLSVSFSADNRQIVSGSRDRTIKLWNTLGDCKYTITDKGHTEWVSCVRFSPNPQNPVIVSAGWDKLVKVWELASCRLQTDHIGHTGYINTVTISPDGSLCASGGKDGVTMLWDLNESKHLYSLHAGDEIHALVFSPNRYWLCAATSSSITIFDLEKKSKVDELKPEYIEKGKKSREPECVSLAWSADGQTLFAGYTDNKIRAWGVMSRA

SEQ ID NO: 27246 - protein, 381 aa, Arabidopsis thaliana
MGKKKKRATEKVWCYYCDREFDDEKILVQHQKAKHFKCHVCHKKLSTASGMVIHVLQVHKENVTKVPNAKDGRDSTDIEIYGMQGIPPHVLTAHYGEEEDEPPAKVAKVEIPSAPLGGVVPRPYGMVYPPQQVPGAVPARPMYYPGPPMRHPAPVWQMPPPRPQQWYPQNPALSVPPAAHLGYRPQPLFPVQNMGMTPTPTSAPAIQPSPVTGVTPPGIPTSSPAMPVPQPLFPVVNNSIPSQAPPFSAPLPVGGAQQPSHADALGSADAYPPNNSIPGSIPSGTNAHSYASGPNTSGPSIGPPPVIANKAPSNQPNEVYLVWDDEAMSMEERRMSLPKYKVHDETSQLAIVGSEKHSMNSINAAIDRRISESRLAGRMAF

SEQ ID NO: 27247 - protein, 374 aa, Homo sapiens [sequence omitted]

SEQ ID NO: 27248 - protein, 110 aa, Synechococcus sp.
LISDGDVSAAISCGFAGTNTHALMGIVIGEGERDEAPMLYIGEEVGIYRLQEMGITDPDRRYDANELAFVDTVHMFDDVKSLGGHFQGQLIYDPEVVKGGLFAAPDFYMK

SEQ ID NO: 27249 - protein, 112 aa, Synechococcus sp.
MKKIEAIIRPFKLDEVKIALVNAGIVGMTVSEVRGFGRQKGQTERYRGSEYTVEFLQKLKLEIVVEDAQVDTVIDKIVAAARPGEIGDGKIFVSPVDQTIRIRTGEKNADAI

SEQ ID NO: 27250 - protein, 547 aa, Acremonium sp. No.413
MKSRIALASAIGIGMAGAAPAASQPLLPLPPMGFNNWARFMTNISESIFVDAAEALVKTGLRDVGYNRLNLDDGWSTMNRAANGSMVWDSKKFPKGFPWLTSYMKSNGFIPGLYTDAGRLSCGGYPGALDHEDIDWNDFKAWGFEYLKMDGCNLPDSSEPVYREVYSRWGQLIAKDPEPMVFSDSAPAYFSSDNGLTNLTNWYTVMGWAQKMGHLARHSADIQTYPDGNSWKSMMFNYNEHVRLARYQTIGFFNDPDFLNVDHPSYSLDEKKSHFALWCTFSAPLLLSTDLTAITDEEVKYLSNKDLIAINQDKLIQQATLVSRDDNWDVLSKDVENGDRIVTILNKGASAGSLTVSWERAGLSTEALLGGPDVSVKNLWTGETAKTAVASGGITASDVPSHGTAVFRIAKSVSPVTPTGLIFNTLSMKCLTDDESGQVSFKACDGSDGQTWQVRQDGHISSLLRPDKCIVDDQGNILSSSSGDSTDVWSYGVSGNLINGNSANCLTESGDGTATATNCGNELGSQVVALPVGVIVNDNKGGLLSDL

SEQ ID NO: 27251 - protein, 226 aa, Arabidopsis thaliana
MGGCCCCSSSRRADVDNGPAYYYYPRATEERVPLSSAHNRTSSAISTGVVVVDTNLETSSPDAYIPPPLPTPFDVPIGIPQTPASGEEATCVDIREVSVDSANTESAQETVDGITLGVPTTCSHKETDSKIQTEIDLESTEEIDPKLSKAVFIPIEEEEDCPICLEEYDIENPKLVAKCDHHFHLACILEWMERSETCPVCNKAQFSLYQKKEIGEQEKNLKRKNG

SEQ ID NO: 27252 - protein, 223 aa, Arabidopsis thaliana
MQCPLSGQTEQRKVAKAYGSKGRRRQRRERKDRYYSGNFILHFFDEPEKSSILELVNTGKFLGFLLLLDFLRSLSQSVYHSPPTPLPYDADPRYFRFVKGSSHSGEESEPLRGDTEMSSEALGDGGAKWSKSDSEDGSKEVYTKGSSTFTKSKTMPGIEVYYADSDDEDICPTCLDDYTLENPKIITKCSHHFHLSCIYEWMERSETCPVCGKVMAFDENETS

SEQ ID NO: 27253 - protein, 544 aa, Arabidopsis thaliana
MASRKTTSLLNHLLLLGALTLLSSLVIVKGESPYKFYTWTVTYGIISPLGVPQQVILINGQFPGPKLEVVTNDNIILNLINKLDQPFLLTWNGIKQRKNSWQDGVLGTNCPIQPNSNFTYKFQTKDQIGTFNYFPSTAFHKAAGGFGAINVYARPGIPIPYPLPTADFTLLVGDWFKTNHKTLQQRLDSGGVLPFPDGMLINGQTQSTFSGDQGKTYMLRISNVGLSSTFNFRIQGHTMKVVEVEGSHVIQTDYDSLDIHVGQSLAVLVTLNQSPKDYYIVASTRFIRSKLSVMGLLRYSNSRVPASGDPPALPPGELVWSMRQARTFRWNLTANAARPNPQGSFHYGMISPTKTFVFSNSAPLINGKQRYAVNGVSYVKSETPLKLADHFGISGVFSTNAIQSVPSNSPPTVATSVVQTSHHDFLEIVFQNNEKSMQSWHLDGYDFWVVGFGSGQWTPAKRSLHNLVDALTRHTTQVYPESWTTILVSLDNQGMWNMRSAIWERQYSGQQFYLKVWNSVQSLANEYNPPDNLQLCGKAVGRHV

SEQ ID NO: 27254 - protein, 317 aa, Arabidopsis thaliana
MENGDIPEDANEHCPGPQSESAGKSDSCAGCPNQEACATAPKGPDPDLVAIAERMSTVKHKILVLSGKGGVGKSTFSAQLSFALAGMDHQVGLMDIDICGPSIPKMLGLEGQEIHQSNLGWSPVYVEDNLGVMSIGFMLPNSDEAVIWRGPRKNGLIKQFLKDVYWGEIDYLVVDAPPGTSDEHISIVQYLLPTGIDGAIIVTTPQEVSLIDVRKEVSFCKKVGVPVLGVVENMSGLSQPLLDIVACSEVFDSSGGGAERMCREMGVPFLGKVPMDPQLCKAAEQGKSCFEDNKCLISAPALKSIIQKVVPSTVMTE

SEQ ID NO: 27255 - protein, 111 aa, Arabidopsis thaliana
MEVVVNKAKEIVSAYPVVVFSKTYCGYCQRVKQLLTQLGATFKVLELDEMSDGGEIQSALSEWTGQTTVPNVFIKGNHIGGCDRVMETNKQGKLVPLLTEAGAIADNSSQL

SEQ ID NO: 27256 - protein, 220 aa, Arabidopsis thaliana
MDGLLLDTEKFYTEVQEIILARFNKKFDWSLKAKMMGRKAIEAARIFVEESGISDSLSAEDFLVERESMLQDLFPTSELMPGASRLIKHLHVKNIPICIATGTHTRHYDLKTQRHRELFSLMHHVVRGDDPEVKQGKPAPDGFLAAARRFKDGPVDSQKVLVFEDAPSGVLAAKNAGMNVVMVPDPRLDISHQDVADQIITSLVDFKPEEWGLPPFEDSN

SEQ ID NO: 27257 - protein, 558 aa, Arabidopsis thaliana
MTSSEEVVEVTVVKAPEAGGGKLSRRKIRKKDAGVDGLVKWERFLPKIALRVLLVEADDSTRQIIAALLRKCSYRVAAVPDGLKAWEMLKGKPESVDLILTEVDLPSISGYALLTLIMEHDICKNIPVIMMSTQDSVNTVYKCMLKGAADYLVKPLRRNELRNLWQHVWRRQTSLAPDSFPWNESVGQQKAEGASANNSNGKRDDHVVSGNGGDAQSSCTRPEMEGESADVEVSARDAVQMECAKSQFNETRLLANELQSKQAEAIDFMGASFRRTGRRNREESVAQYESRIELDLSLRRPNASENQSSGDRPSLHPSSASAFTRYVHRPLQTQCSASPVVTDQRKNVAASQDDNIVLMNQYNTSEPPPNAPRRNDTSFYTGADSPGPPFSNQLNSWPGQSSYPTPTPINNIQFRDPNTAYTSAMAPASLSPSPSSVSPHEYSSMFHPFNSKPEGLQDRDCSMDVDERRYVSSATEHSAIGNHIDQLIEKKNEDGYSLSVGKIQQSLQREAALTKFRMKRKDRCYEKKVRYESRKKLAEQRPRIKGQFVRQVQSTQAP

SEQ ID NO: 27258 - protein, 1173 aa, Arabidopsis thaliana
MSITCELLNLTSKKAKKSSSSDKKWLKKPLFFLILCGSLVIVLVMFLRLGRSQKEETDSCNGEEKVLYRHQNVTRSEIHDLVSLFSDSDQVTSFECHKESSPGMWTNYGITCSLSVRSDKQETRGLPWNLGLGHSISSTSCMCGNLEPILQQPENLEEENHEEGLEQGLSSYLRNAWWCLILGVLVCHKIYVSHSKARGERKEKVHLQEALAPKKQQQRAQTSSRGAGRWRKNILLLGILGGVSFSVWWFWDTNEEIIMKRRETLANMCDERARVLQDQFNVSLNHVHALSILVSTFHHGKIPSAIDQRTFEEYTERTNFERPLTSGVAYALKVPHSEREKFEKEHGWAIKKMETEDQTVVQDCVPENFDPAPIQDEYAPVIFAQETVSHIVSVDMMSGEEDRENILRARASGKGVLTSPFKLLKSNHLGVVLTFAVYDTSLPPDATEEQRVEATIGYLGASYDMPSLVEKLLHQLASKQTIAVDVYDTTNTSGLIKMYGSEIGDISEQHISSLDFGDPSRNHEMHCRFKHKLPIPWTAITPSILVLVITFLVGYILYEAINRIATVEEDCQKMRELKARAEAADIAKSQFLATVSHEIRTPMNGVLGMLKMLMDTDLDAKQMDYAQTAHGSGKDLTSLINEVLDQAKIESGRLELENVPFDMRFILDNVSSLLSGKANEKGIELAVYVSSQVPDVVVGDPSRFRQIITNLVGNSIKERGHIFISVHLADEVKEPLTIEDAVLKQRLALGCSESGETVSGFPAVNAWGSWKNFKTCYSTESQNSDQIKLLVTVEDTGVGIPVDAQGRIFTPFMQADSSTSRTYGGTGIGLSISKRLVELMQGEMGFVSEPGIGSTFSFTGVFGKAETNTSITKLERFDLAIQEFTGLRALVIDNRNIRAEVTRYELRRLGISADIVSSLRMACTCCISKLENLAMILIDKDAWNKEEFSVLDELFTRSKVTFTRVPKIFLLATSATLTERSEMKSTGLIDEVVIKPLRMSVLICCLQETLVNGKKRQPNRQRRNLGHLLREKQILVVDDNLVNRRVAEGALKKYGAIVTCVESGKAALAMLKPPHNFDACFMDLQMPEMDGFEATRRVRELEREINKKIASGEVSAEMFCKFSSWHVPILAMTADVIQATHEECMKCGMDGYVSKPFEEEVLYTAVARFFEPC

SEQ ID NO: 27259 - protein, 495 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGSLHISCLYCLCVCLL

SEQ ID NO: 27260 - protein, 307 aa, Arabidopsis thaliana
MATNGRFFTIGLVASWYSSNIGVLLLNKYLLSNYGFKYPIFLTMCHMTACSLLSYVAIAWLKMVPMQTIRSRVQFFKIAALSLVFCVSVVFGNISLRFLPVSFNQAIGATTPFFTAVFAYLMTRKKEAWLTYFTLVPVVTGVVIASGGEPSFHLFGFLMCIAATAARALKSVLQGILLSSEGEKLNSMNLLLYMAPIAVVLLLPATLIMEKNVVGITIALARDDFRIVWYLLFNSALAYLVNLTNFLVTNHTSALTLQVLGNAKGAVAVVVSILIFKNPVSVTGMLGYSLTVCGVILYSEAKKRNKN

SEQ ID NO: 27261 - protein, 263 aa, Arabidopsis thaliana
METDSIDSVIDDDEIHQKHQFSSTKSQGGATVVISPATSVYELLECPVCTNSMYPPIHQCHNGHTLCSTCKSSKLKHESQCNFRPYSCPYAGSECAAVGDITFLVAHLRDDHKVDMHTGCTFNHRYVKSNPREVENATWMLTVFQCFGQYFCLHFEAFQLGMAPVYMAFLRFMGDEDDARNYTYSLEVGGSGRKQTWEGTPRSVRDSHRKVRDSHDGLIIQRNMALFFSGGDKKELKLRVTGRIWKEQQNPDSGVCITSMCSS

SEQ ID NO: 27262 - protein, 468 aa, Arabidopsis thaliana
MRFLSLVGNSFGCSASGERLVSAARDGDLQEAKALLDYNPRLARYSTFGVRNSPLHYSAAQGHHEIVSLLVESGVDINLRNYRGQIHRSDYLNGGTALHLAALNGHPRCIRILLSEYIPSVPNCWSLLKNKKTSVAGFDSSVLHEVINRAADGGITPLHVAALNGHIETVQLLLDLGASVTQVLGVQLSIMLHVVETRSVASKGACLAAVNSNGWTPMMVARSWHRNWLEEILNPTTEQPQLHLPNVPSPFLCLPLMSIVNIAQECGWRENDCLTPCRDPCAVCLERKCTVAADGCAHEFCTNCALYLSTTSITSSKTSNVTPGSVPCPLCRNGIVSFTKLPHTTATTRTSTSSRTSISLSFCTCSSDVLDTALLTNPHYSCKPVVSRTGSRTPQSARSSAFRSLSCRRFPPSLCLGGSDVDEPRSRLIGGSYSRSGVGFRRSTSQVEGKRSWFSALNHCVTTGGSAC

SEQ ID NO: 27263 - protein, 1105 aa, Arabidopsis thaliana
MEEENAVEILQRYRRDRRKLLDFMLAGSLIKKVIMPPGAVTLDDVDLDQVSVDYVINCAKKGGMLELAEAIRDYHDHIGLPYMNSVGTADEFFLATIPESSGSPPKRAPPPIPVLISSSSPMVTNPEWCESPSAPPLMRSESFDSPKAQELTVDDIDDFEDDDDLDEVGNFRISRRTANDAADLVPRLPSFATVARANYDWTISSTPTPMKSQGPADLLRKLQCISVSGITDDDLRETAFEILLACAGASGGLIVPSKEKKKEKSRSRLIKKLGRKSESVSQSQSSSGLVSLLEMMRGQMEISEAMDIRTRQGLLNALAGKVGKRMDSLLVPLELLCCVSRTEFSDKKAYLRWQKRQLNMLAEGLINNPVVGFGESGRKATDLKSLLLRIEESESLPSSAGEVQRAECLKSLREVAISLAERPARGDLTGEVCHWADGYHLNVRLYEKLLLCVFDILNDGKLTEEVEEILELLKSTWRVLGITETIHYTCYAWVLFRQYVITSERGLLRHAIQQLKKIPLKEQRGPQERLHLKTLKCRVDNEEISFLESFLSPIRSWADKQLGDYHLHFAEGSLVMEDTVTVAMITWRLLLEESDRAMHSNSSDREQIESYVLSSIKNTFTRMSLAIDRSDRNNEHHLALLAEETKKLMKKDSTIFMPILSQRHPQAIAFSASLIHKLYGNKLKPFLDGAEHLTEDAVSVFPAADSLEQYLLELMTSVCGEDTSGPYFKKLIPYEHWDPISPQQRYGSSIVEVFRIVEETVDQFFALKVPMRSIELSALFRGIDNAFQVYTNHVMEKLASKDDLVPPVPVLTRYKKETAIKVFVKKELFDSKHLDERRSINIDVPATAMLCVQLNTLHYAVSQLSKLEDSMWLRWIAKKPREKIVIRKSMVEKSKSFNQKESFEGSRKDINAALDRICEFTGTKIIFCDLREPFIENLYKPNVSQSRLEGLIEALDTELGQLCSVIMEPLRDRIVTSLLQASLDGLLRVLLDGGASRVFHPSESKLLEEDVEVLKEFFISGGDGLPRGVVENQVARVRLVVKLHGYETRELIDDLRSRSSLEMQQGGKGKLGADTQTLVRVLCHRNDSEASQFLKKQYKIPRSHG

SEQ ID NO: 27264 - protein, 384 aa, Synechococcus sp.
MTQATELLDPALKPAETKAKRSSRKKATTAVVEPATTIAPTADVDAIDDEDSVGEDEDAAAKAKAKVRKTYTEDSIRLYLQEIGRIRLLRADEEIELARQIADLLALERIRDELLEQLDRLPSDAEWAAAVDSPLDEFRRRLFRGRRAKDKMNQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIEADGETPEDEVAKNLLREDLEGVLSTLSPRERDVLRLRYGLDDGRMKTLEEIGQLFNVTRERIRQIEAKALRKLRHPNRNSILKEYIR

SEQ ID NO: 27265 - protein, 304 aa, Mus musculus
MKGKEEKEGGARLGTGGGGSPDKSPSAQELKEQGNRLFVGRKYPEAAACYGRAITRNPLVAVYYTNRALCYLKMQQPEQALADCRRALELDGQSVKAHFFLGQCQLEMESYDEAIANLQRAYSLAKEQRLNFGDDIPSALRIAKKKRWNSIEERRIHQESELHSYLTRLIAAERERELEECQRNHEGHEDDGHIRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 27266 - protein, 371 aa, Mus musculus
MAAAEAANCIMENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 27267 - protein, 756 aa, Mus musculus
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADVQHWVQGLRKIIDRSGSMDQRQKLQHWIHSCLRKADKNKDNKMNFKEVKDFLKELNVQVDDSYARKIFRECDHSQTDSLEDEEIETFYRMLTQRAEIDRAFAEAAGSAETLSVEKLVTFLQHQQREEEAGPALALSLIERYEPSETAKAQRQMTKDGFLMYLLSADGNAFSLAHRRVYQDMNQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMAHHLRAILGPMLLDQPLDGVTTSLPSPEQLKEKILLKGKKLGGLLPAGGENGPEATDVSDEDEAAEMEDEAVRSQVQHKPKEDKLKLVPELSDMVIYCKSVHFGGFSSPSTSGQAFYEMASFSESRALRLLQESGNSFVRHNVGHLSRIYPAGWRTDSSNYSPVEMWNGGCQIVALNFQTPGPEMDVYLGCFQDNGGCGYVLKPAFLRDPDTTFNSRALTQGPWWAPKKLRVWIISGQQLPKVNKNKNSIVDPKVIVEIHGVGQDVASRQTAVITNNGFNPRWDTEFEFVVAVPDLALVRFMVEDYDSSSKNDFIGQSTIPWNSLKQGYRHVHLLSKNGDLHPSATLFVKISIQD

SEQ ID NO: 27268 - protein, 139 aa, Agaricus bisporus
MSGKGKAGKSGGKAGSETKSMSRSSKAGLQFPVGRVHRLLKKGNYAQRVGAGAPVYMAAVLEYLAAEILELAGNAARDNKKQRIVPRHLQLAIRNDEELHKLLGNVVISQGGVVPHIAPELLPSKSSKGKKDEGVSQEL

SEQ ID NO: 27269 - protein, 266 aa, Triticum aestivum; identical to SEQ ID NO: 4965

SEQ ID NO: 27270 - protein, 259 aa, Triticum aestivum; identical to SEQ ID NO: 960

SEQ ID NO: 27271 - protein, 101 aa, Macaca mulatta
GVRNVASVCLQIGYPTVASVPHSIINGYKRVLALSVETDYTFPLAEKVKAFLADPSAFVAAAPVAAATTAAPAAAAAAPAKVEAKEESEESDEDMGFGLFD

SEQ ID NO: 27272 - protein, 472 aa, Artemisia annua
MSLNTLSPSEIRVNSFLDTTKSNTNLFKLQGGVSVKRKDSKVNGIQCSAAASTPPPAWPGTALVQPGTKNWSGPKPISIIGSTGSIGTQTLDIVAENPDKFKVVALAAGSNVTLLAEQIKAFKPQLVSIKNESLVAELKEALAGSDYMPEIIPGDEGVVEVARHPDCVTVVTGIVGCAGLKPTVAAIEAGKNIALANKETLIAGGPFVLPLAHKHNVKILPADSEHSAIFQCIQGFPEGALRRIILTASGGAFRDWPVEKLKDVKVADALKHPNWSMGRKITVDSATLFNKGLEVIEAHYLYGSSYDNIDIVIHPQSIIHSMVETQDSSVLAQLGWPDMRLPILYTLSWPDRVQCSEITWPRLDLCKLGSLTFKAPDNVKYPSMHLAYSAGRAGGTMTGVLSAANEKAVEMFLDEKIGYLDIFKVVELTCEKHQAELVTAPSLEEIIHYDLWAREYAASVKPSSSGLTPALV

SEQ ID NO: 27273 - protein, 472 aa, Zea mays; identical to SEQ ID NO: 6731

SEQ ID NO: 27274 - protein, 188 aa, Streptococcus mutans
MEEQNIEKKILLCLTGSGALLGIAEYITFLTVRFKHVRVIVSDNAAKMLPVAAITQLCEKVYTDEVSFTDKQKNHIALTRWADITVVLPATANIIGKVANGIADNFMTTTLLSSSKPVLIYPCMNNIMWENPVVQKNVEVLSGTQYKVIVGQESESFELASGKMKKNIAIPSLDELQRVVLENLQEER

SEQ ID NO: 27275 - protein, 211 aa, Gossypioides kirkii
AKGQTPLFPRILAHEAGGIVESVGEGVTDLKPGDHVLPVFTGECGNCRHCKSKESNMCDLLRINADRGVMLSDGKTRFSINGKPIYHFLGTSTFSEYTVAHVGSVAKINLAAPLDKVCVLSCGISTGLGATLNVAKPTKGSTVAIFGLGAVGLPATEGARIAGASRIIGVDLNPNRFEEAKKFGCTEFVNPKDHNKPVQEVLAEMTNGGVD

SEQ ID NO: 27276 - protein, 211 aa, Gossypium robinsonii
AKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQKVLAEMTNGGVD

SEQ ID NO: 27277 - protein, 211 aa, Gossypium raimondii
AKGQTPLFPRIFGHEAGGIVDSVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTDGGVD

SEQ ID NO: 27278 - protein, 211 aa, Gossypium hirsutum
AKGQTSLFPRIFGHEAGGIVESVGEGVTHLKPGDHVLPVFTGECGNCRHCKSKESNMCDLLRINTNRGVMLSDGKTRFSINGKPIYHFVGTSTFSEYTVAHVGSVAKINPAAPLDKVCILSCGISTGLGATLNVAKPTKGSTVAIFGLGAVGLAAAEGASIAGASRIIGVDLNPNRFEEAKKFGCTEFVNPKDHNKPVQEVLAEMTNGGVD

SEQ ID NO: 27279 - protein, 211 aa, Gossypium hirsutum
AKGQTPLFPRIFGHEAGGIVDSVGEGVTHLKPGDHVLPVFTGECGNCCHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTDGGVD

SEQ ID NO: 27280 - protein, 233 aa, Gossypium robinsonii
KILFTSLCHTDVYYWEAKGQTPVFPRIFGHEAGGVVESVGEGVTELKPGDHVLPVFTGECGDCGHCKSEESNMCDLLRINTDRGVMLSDGKTRFSINGKPIYHFVGTSTFSEYTVVHVGCVAKVNPAAPLDKICVLSCGISTGLGATLNVAKPTKGSTVAIFGLGAVGLAAAEGARIAGASRIIGVDLNPNRFEEAKKFGCNEFVNPKDYDKPVQEVLAEMTNGGVDRSVECT

SEQ ID NO: 27281 - protein, 203 aa, Gossypium raimondii
AKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKIFVLSCGISTGLGAILNVAKPTKGSTVAIFGLGAVGLAAAEGARIAGASRIIGVDLNPNRFEEAKKFGCNEFVNPKDYDKPVQEVLA

SEQ ID NO: 27282 - protein, 230 aa, Gossypium hirsutum
LFTSLCHTDVYFWEAKGQTPVFPRIFGHEAGGVVESVGEGVTELKPGDHVLPVFTGECGDCRHCKSEESNMCDLLRINTDRGVMLSDGKTRFSINGKPIYHFVGTSTFSEYTVVHVGCVAKVNPAAPLDKICVLSCGISAGLGATLNVAKPTKGSTVAIFGLGAVGLAAAEGARIVGASRIIGVDLNPNRFEEAKKFGCNEFVNPKDYDKPVQEVLAEMTNGGVDRSVEC

SEQ ID NO: 27283 - protein, 230 aa, Gossypium hirsutum
LFTSLCHTDVYFWEAKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKIFVLSCGISTGLGAILNVAKPTKGSTVAIFGLGAVGLAAAEGARIAGASRIIGVDLNPNRFEEAKKFGCNEFVNPKDYDKPVQEVLAEMTNGGVDRSVEC

SEQ ID NO: 27284 - protein, 1092 aa, Arabidopsis thaliana
MSLFHVLGFGVKIGHLFWMLCCWFVSWFVDNGIEDKSGLLVGSVGDLEKTKMTTLKKKNKMWFWNKISSSGLKIPSFSYQFLGSVKFNKAWWRKLVVVWVVFWVLVSIWTFWYFSSQAMEKRKETLASMCDERARMLQDQFNVSMNHVQAMSILISTFHHGKIPSAIDQRTFSEYTDRTSFERPLTSGVAYAMRVLHSEREEFERQQGWTIRKMYSLEQNPVHKDDYDLEALEPSPVQEEYAPVIFAQDTVSHVVSLDMLSGKEDRENVLRARSSGKGVLTAPFPLIKTNRLGVILTFAVYKRDLPSNATPKERIEATNGYLGGVFDIESLVENLLQQLASKQTILVNVYDITNHSQPISMYGTNVSADGLERVSPLIFGDPLRKHEMRCRYLQLAHTYVCNFFLFARIQVLTFCCELLPLCRFKQKPPWPVLSMVTSFGILVIALLVAHIIHATVSRIHKVEEDCDKMKQLKKKAEAADVAKSQFLATVSHEIRTPMNGVLGMLHMLMDTELDVTQQDYVRTAQASGKALVSLINEVLDQAKIESGKLELEEVRFDLRGILDDVLSLFSSKSQQKGVELAVYISDRVPDMLIGDPGRFRQILTNLMGNSIKFTEKGHIFVTVHLVDELFESIDGETASSPESTLSGLPVADRQRSWENFKAFSSNGHRSFEPSPPDINLIVSVEDTGVGIPVEAQSRIFTPFMQVGPSISRTHGGTGIGLSISKCLVGLMKGEIGFSSTPKVGSTFTFTAVFSNGMQPAERKNDNNQPIFSEFRGMKAVVVDHRPARAKVSWYHFQRLGIRVEVVPRVEQALHYLKIGTTTVNMILIEQEIWNREADDFIKKLQKDPLFLSPKLILLANSVESSISEALCTGIDPPIVIVKPLRASMLAATLQRGLGIGIREPPQHKGPPALILRNLLLGRKILIVDDNNVNLRVAAGALKKYGADVVCAESGIKAISLLKPPHEFDACFMDIQMPEMDGFEATRRIRDMEEEMNKRIKNGEALIVENGNKTSWHLPVLAMTADVIQATHEECLKCGMDGYRIIRGDGAGRRTAKETQKLVSPMHLEVVEKQIDDCKKSVYRKAGVTRPRT

SEQ ID NO: 27285 - protein, 391 aa, Danio rerio
MAESGSSAAAAEPGSNSSAAGPGGAVAPGGPSGAAGSKPGLESVKGQNFDVGPRYTDLQYIGEGAYGMVCSAFDNVNKIRVAIKKISPFEHQTYCQRTLREIKILLRFHHENIIGINDILRARHIDYMRDVYIVQDLMETDLYKLLKTQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGVLGSPSQDDLNCIINMKARNYLQSLPQKPKIPWNKLFPKADNKALDLLDRMLTFNPIKRINVEQALAHPYLEQYYDPSDEPVAEEPFTFNMELDDLPKEKLKELIFEETARFQANYQGS

SEQ ID NO: 27286 - protein, 369 aa, Danio rerio
MATAAVSAPAGGGPNPGSGAEMVRGQAFDVGPRYSNLSYIGEGAYGMVCSAYDRDNKVRVAIKKISPFEHQTYCQRTLREIKIPVRFKHENIIGINDIIRTPTIDQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINIKARNYLLSLPLRSKVPWNRLFPNADPKALDLLDKMLTFNPHKRIEVEEALAHPYLEQYYDPTDEPVAEAPFKFDMELDDLPKETLKELIFEETARFQPGNRP

SEQ ID NO: 27287 - protein, 503 aa, Acinetobacter sp. M-1
MHYVDPNQSGSKIHFKDQYENFIGGQWVAPVKGVYFDNISPVDGKSFTRIPRSSAEDIELALDAAHKAKKEWNKSSPTTRSNLLLKIADRMEANLEMLAVAETWDNGKPVRETLAADIPLAIDHFRYFAGCIRAQEGGISEIDEDTIAYHFHEPLGVVGQIIPWNFPILMAAWKLAPALAAGNCVVIKPAEQTPVGILLVAELIQDLLPAGVLNIVNGYGAEVGRPLATSPRIAKIAFTGSTQVGQLIMQYATENIIPVTLELGGKSPNVFFADVMDHDDDFLDKTLEGFAMFALNQGEVCTCPSRALIQESIADQFMEKAIERVKRIKLGHPLDTDTMVGAQASLEQQEKILRCIDTGRQEGAEVLLGGHGRQEVGNGYYIEPTIFKGHNNMQVFQEEIFGPVLSVTTFKDFDEAIQIANDTMYGLGAGVWSRSTHTAYRAGRAIEAGRVWTNCYHIYPAHAAFGGYKKSGVGRENHKMMLDHYQQTKNLLVSYSTKAMGFF

SEQ ID NO: 27288 - protein, 398 aa, Synechococcus elongatus
MTAAYFTHSTEYEAVSSDVANLSETPSSEAVETAVSSRQSTDLIRLYLQDIGRVRLLGRDEEVSEARWVQRYMQLLAVRNCVAVEEGGVLKDYVDLQEGRDRLTAQLGHRPSFEAWAKIVDCSLTELRQALQLGLHRWAEVCQLDLEELKQVCKEGQRAKDHMIKANLRLVVSVAKKYQNRGLELLDLVQEGTLGLERAVEKFDPTKGYRFSTYAYWWIRQGITRAIATQSRTIRLPVHVTEKLTRIKKAQRKIAQTKGRTANLEEIAQELEMTPDQVREVLLRVPKSISLETRVGKEKDTELGDLLETTDFTPEERLTQESLSNDLQRLLLELNHRERDVIRMRFGLRDGQIYSLAEIGQVLDLSRERVRQIEAKALQKLRHPRRRNQIRDYLELLH

SEQ ID NO: 27289 - protein, 102 aa, Beta vulgaris
MASSSSSSPVALSKRGRPRNSGAKNPVFCSVDGCASDLNQCREYHRRHKVCERHSKTPVVLVGGKKPQFCQHCSGCKKIIREESNAQRLPCLSWLENPTGDF

SEQ ID NO: 27290 - protein, 917 aa, Botryotinia fuckeliana
MPSLHGLWSHINVTLANLTNNRDEDGDHIDSDTPRSGVATPQPDPSDKRTPGILHSFYGQVGLGSSSSQNSAKHISRTSQNPNTSALEGHYTSPRQRFEAEGALLKATPSSLDERRIDGGVEKENSLLPPHELLGSSQISKQQYPYPTPPVSHPSSLHKVKLSDASFEDIGNNVQKTAAPTDRDCISESIPSHARRASSMTPLSNIVTPSNVHAAHFSNPSDTPSEHKLSTPPLSRLNSEFHKSPSYDRLKKLTCDGLKSIPSTPTRALSNQTSKSDQSVMSTNSEHVAQNGKSGASERPAVTPRTDSSMGGTVVPPKGKLTVKINEARGLRRSVDPYVVAVFQRNELVSKGPQSEEDDEDDGNSHSPGGIPIGGIPIGGIPITRSGSDSGRSMAIPMKSRQSSNTSLSEYRDFKNKGRKMFTHPKWDAEAVFDVVGSDTRVNITIYDRAQQAEEFLGHVDLQANLVENVDAPVSGWFQLRGKDMTSNAGNVGEVHVEISFQRTEKRHYGPDDFQILKLIGKGTFGQVYQVRKKDTKRIYAMKVLQKKVIVQKKEVAHTVGERNILVRTATADSPFIVGLKFSFQTPTDLYLVTDYMSGGELFWHLQKEGRFDEQRAKFYIAELILALEHLHKHDIVYRDLKPENILLDANGHIALCDFGLSKANLTKNATTNTFCGTTEYLAPEVLLDEAGYTKMVDFWSLGVLVFEMCCGWSPFYAEDTQQMYKNIAFGKVRFPRDTLTTEGRNFVKGLLNRNPKHRLGATDDAEELKRHPFFQDIDWHALTQKLITPPFKPKLKSETDTSNFDPEFTNALNGASSLNARAAALAAGMATSTPLSPGMQANFKGFTFVDESSIEENMKDRIKDEYEDRMDQDNNDPERDWEDTFDIPDKSRMDRMSGVVRNHNEDERMFNGDDFH

SEQ ID NO: 27291 - protein, 2549 aa, Rattus norvegicus
MLGTGPATATAGAATSSNVSVLQQFASGLKSRNEETRAKAAKELQHYVTMELREMSQEESTRFYDQLNHHIFELVSSSDANERKGGILAIASLIGVEGGNSTRIGRFANYLRNLLPSSDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGASPSPTKSTLVESRCCRDLMEEKFDQVCQWVLKCRSSKNSLIQMTILNLLPRLAAFRPSAFTDTQYLQDTMNHVLSCVKKEKERTAAFQALGLLSVAVRSEFKVYLPRVLDIIRAALPPKDFAHKRQKTVQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVASITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFVIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSQGRIVSIKLLAAIQLFGANLDDYLHLLLPPIVKLFDAPEVPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSSQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAASGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTTATTAASAAAATSTEGSNSESEAESNESSPTPSPLQKKVTEDLSKTLLLYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRTTCHTVMEVLREHKDSVMAVLEAFVYDPLLNWRLMDTNAKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 27292 - protein, 512 aa, Homo sapiens
MLFEGLDLVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 27293 - protein, 1173 aa, Mus musculus
MAGAQPGVHALQLKPVCVSDSLKKGTKLVKWDDDSTIVTPTILRTDPQGFFFYWTDQNKETELLDLSLVKDARCGKHAEAPKDPKLRELLDVGNIGHLEQRMITVVYGPDLANISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPDVYRVFLNNLCPRPEIDNIFSEFGAKSKPYLTVDQMMDFINLKQRDPRLNEILYPPLKQEQVQVLIEKYEPNSSLAKKGQMSVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMMALNFQTVDLAMQINMGMYEYNGKSGYRLKPEFMRRPDKHFDPFTEGIVDGIVANTLSVKIISGQFLSDKKVGTYVEVDMFGLPVDTRRKAFTTKTSQGNAVNPVWEEEPIVFKKVVLPSLACLRIAAYEEGGKFIGHRILPVQAIRPGYHYICLRNERNQPLTLPAVFVYIEDKDYVPDTYADVIEALSNPIRYVNLMEQRAKQLAALTLEDEEEVKKEADPGETSSEAPSETRTTPAENGVNHTASLAPKPPSQAPHSQPAPGSVKAPAKTEDLIQSVLTEVEAQTIEELKQQKSFVKLHKKHYKEMKDLVKRHHKKTTELIKEHTTKYNEIQIDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKRQEKITEATSKDKSQMEEEKTEMIRSYIQEVVQYIKRLEEAQSKRQEKLVEKHNEIRQQILDEKPKGEGPSSVLSEGCHEDPSVPPNFTPPNPQALKW

SEQ ID NO: 27294 - protein, 745 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAQFPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 27295 - protein, 691 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAQFPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 27296 - protein, 301 aa, Leishmania major
MTSRYERQEKIGEGTYGVVYKARDTSTSATVALKRIRLDSEEEGVPCTAIREISLLKELRHENIVKLLDVCHSEHRLTIVFEYLDLDLKKYLDRENGNLDAATIQHFMRDLLRGVAFCHQRSVLHRDLKPQNLLISREKELKLGDFGLGRSFAIPVRKFTNEVVTLWYRPPDVLLGSMQYGPPVDVWSVGCIFSEMATGTPLFAGKNDADQLMRIFRFLGTPNNRVWPSMNQYPNSNNMLSQPEFLQNFEPEWSNVLGSVPGYEKLGCAGVDLLEKLLRYEPSERITAADALNHPYFSLQF

SEQ ID NO: 27297 - protein, 612 aa, Vigna unguiculata
MPSSASNTWFNATLPSPPFKDLPSTSSPTNLLPLRKTSSSNTITCSLQTLHFPKQYQPTSTSTSTATTTTPTPIKTTTITTTTPPRETNPLSDTNQPLPQKWNFLQKAAATALDLVETALVSHERKHPLPKTADPRVQIAGNFAPVPEHAADQGLPVVGKIPKCIDGVYVRNGANPLYEPVAGHHFFDGDGMVHAVKFTNGAASYACRFTETQRLSQEKSLGRPVFPKAIGELHGHSGIARLLLFYARGLFGLVDGSQGMGVANAGLVYFNNHLLAMSEDDLPYHVRITPNGDLTTVGRYDFNGQLNSTMIAHPKLDPVDGDLHALSYDVIQKPYLKYFRFSPDGVKSPDVEIPLKEPTMMHDFAITENFVVVPDQQVVFKLTEMITGGSPVVYDKNKTSRFGILHKNAKDANAMRWIDAPDCFCFHLWNAWEEPETEEVVVIGSCMTPADSIFNECEESLKSVLSEIRLNLRTGKSTRRPIISDAEQVNLEAGMVNRNKLGRKTQFAYLALAEPWPKVSGFAKVDLLSGEVKKYMYGEEKFGGEPLFLPNGQKEDDGYILAFVHDEKEWKSELQIVNAQNLKLEASIKLPSRVPYGFHGTFIHSKDLRKQA

SEQ ID NO: 27298 - protein, 203 aa, Rosa rugosa
MGRGKIEIKRIENSSNRQVTYSKRKNGIIKKAKEITVLCDAKVSLIIIASSGKMVEYCSGPQETRMKILDKYHSQSGKRLWDAKHENLCNEVDRVKKDNDGMQIELRHLKGEDITSLNHVDLMALEEAIENGLASIRDRMSKYMDAVRENNRALEDENKRLAYQLHKMMKSEENLRDMNYNNNTQIPFALRVQPNQPNLHDRM

SEQ ID NO: 27299 - protein, 555 aa, Atriplex gmelini
MWSQLSSLLSGKMDALTTSDHASVVSMNLFVALLCGCIVIGHLLEENRWMNESITALLIGLATGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVVNDATSVVLFNAIQSFDLTRIDHRIALQFMGNFLYLFIASTILGAFTGLLSAYIIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNFAKKSQSEKVTFNQQIVIWWAGLMRGAVSMALAYNQFTRSGHTQLRGNAIMITSTISVVLFSTMVFGLLTKPLIMFLLPQPKHFTSCSTVSDVGSPKSYSLPLLEGNQDYEVDVGNGNHEDTTEPRTIVRPSSLRMLLNAPTHTVHHYWRKFDDSFMRPVFGGRGFVPFVPGSPTEQSTNNLVDRT

SEQ ID NO: 27300 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTHQRNPQEALDQSLQRLGLDYVGLYLVHWPVPLRTENIKDGNLFQFAEKPDGSKDVDLEWNFIKTWELMQKLLESGKTKAIGVSNFSVNNLKDLLAAPTTKVTPAVNQVEFHPLLPQEELIQYCSEKGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 27301 - protein, 328 aa, Moneuplotes crassus
MSTPINQEDTIQNLVDLIKKFSKCKGNIQEKIDTINYMGEYRVNRDILKTTLAGKKMTTWSRSKNKEIKEAAKRVLNEWKTQIKGVNKSSGSSGKSTRSGSTQSQNKSLSEKGAEEKGLVHPDSVVPDDSKPNSNSSEDENEGKDDETKSPEDEEDYDEFILNNETEDKVRNGIRKGLEKLLCKSNENPKKCKALSIKIENSVVLRLGTHLKEYTNKCRSIIANLQRSDEFRSKIINGIFTPDDLAAMNPRDFLEDSLKKKRAKKETRIIDSKRSDYILANSKIKEGMYTCEKCKSKKTTFYEQQTRSADEPMTTFVQCLMCSHNMKF

SEQ ID NO: 27302 - protein, 324 aa, Moneuplotes crassus
INQEDTIQNLVDLIKKFSKCKGNIQEKIDTINYMGEYRVNRDILKTTLAGKKMTTWSRSKNKEIKEAAKRVLNEWKTQIKGVNKSSGSSGKSTRSGSTQSQNKSLSEKGAEEKGLVHPDSVVPDDSKPNSNSSEDENEGKDDETKSPEDEEDYDEFILNNETEDKVRNGIRKGLEKLLCKSNENPKKCKALSIKIENSVVLRLGTHLKEYTNKCRSIIANLQRSDEFRSKIINGIFTPDDLAAMNPRDFLEDSLKKKRAKKETRIIDSKRSDYILANSKIKEGMYTCEKCKSKKTTFYEQQTRSADEPMTTFVQCLMCSHNMKF

SEQ ID NO: 27303 - protein, 436 aa, Lycopersicon esculentum
MSSRLSRPFKSSPFRFVPVLSRYIVEREEPIIRPGNFGLVHPVPVNASRFGPICASFSLRLSRIQIVLLSLSKPFLDYSRGYLHIQLIDPMGAGEESTPTKTSKPPLTQHPLMPPYGTPVPYPALYPPAGVYAHPNIATPAPNSVPANPEADGKGPEGKDRNSSKKLKVCSGGKAGDNGKVTSGSGNDGATQRSDYESYFCKNSSLWIIHASDCFIFFVNSDESRSEGTSDTNDENDNNEFAANKKGSFDQMLADGASAQNNPAKENHPTSIHGNPVTMPATNLNIGMDVWNASAAGPGAIKIQQNATGPVIGHEGRMNDQWIQEERELKRQKRKQSNRESARRSRLRKQLFVKIKLEQEVMAECEELQRRVEALSHENHSLKDELQRLSEECEKLTSENNLIKEELTLLCGPDVVSKLERNDNVTRIQSNVEEAS

SEQ ID NO: 27304 - protein, 355 aa, Fusarium oxysporum f. sp. lycopersici
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 27305 - protein, 507 aa, Triticum aestivum; identical to SEQ ID NO: 4798

SEQ ID NO: 27306 - protein, 371 aa, Leishmania major
MSSAAKDSYPAESSGHLNNEKAQLSKIPSSHPDPSKVTVAPNVKAAYYFAKPDTSSWKLSDFELKNTLGTGSFGRVRIAHRKGTEEYYAIKCLRKREIIKMKQQQHVAQEKGILMELCHPFIVNMMCSFQDEKKVYFLLEFVMGGEMFTHLRTAGRFPNDVAKFYHAELVLAFEYLHSLDVIYRDLKPENLLLDNKGHVKMTDFGFAKKVPDRTFTLCGTPEYLAPEVIQSKGHGKAVDWWTMGVLLYEFIAGYPPFYDDTPFRIYEKILAGRLKFPNWFDGRARDLVKGLLQTDHTKRLGTLKGGPADVKNHPYFHGANWDKLYARYYPAPIPVRVKSPGDTSNFEKYPDSPVDRTPALTSAQQAEFNGF

SEQ ID NO: 27307 - protein, 94 aa, Arabidopsis thaliana
IDGCVLQCETNPLDHLSYPIVSTAGDEDIENILSHVEVKETVTGKIKANSVTVLQTRIEGGAKAVSTRGDLVLQRVRVMYSKAYLYFWFDVDYE

SEQ ID NO: 27308 - protein, 266 aa, Eubacterium sp.
MRLKDKVILVTASTRGIGLAIAQACAKEGAKVYMGARNLERAKARADEMNAAGGNVKYVYNDATKEETYVTMIEEIIEQEGRIDVLVNNFGSSNPKKDLGIANTDPEVFIKTVNINLKSVFIASQTAVKYMAENGGGSIINISSVGGLIPDISQIAYGTSKAAINYLTKLIAVHEARHNIRCNAVLPGMTATDAVQDNLTDDFRNFFLKHTPIQRMGLPEEIAAAVVYFASDDAAYTTGQILTVSGGFGLATPIFGDLSERSDARG

SEQ ID NO: 27309 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTQQRNPQEALDQSLQRLGLDYVDLYLIHWPVPLRTENIKDGNLFQFAEKPDGSKDVDLEWNFIKTWELMQKLLESGKTKAIGVSNFSVNNLKDLLAAPTTKVTPAVNQVELHPLLPQEDLIKFGKENGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 27310 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVIHVGCVAKINPAAPLDKVCVLSCGISTGLGATLNVAKPSKGSSIAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 27311 - protein, 382 aa, Vitis vinifera
MSNTAGQVIKCKAAVSWEAGKPLVIEEVELAPPQANEVRIKILFTSLCHTDVYFWEAKGQKPAFPRIFGHEAAGVVESVGEGVTDLKPGDTVLPVFTGECKECRHCKSEESNMCDLLRINTDRTVMLSDGKSRFSAKGKPIYHFLGTSTFSEYTVAHVGSVAKINPAAPLDKVCVLSCGISTGLGAAINVAKPKKGSSVAVFGLGAVGLAAAEGARISGASRIIGVDLNASRFEQAKKFGVTEFVNPKDHDKPVQEVIAEMTDGGVDRSIECTGSVAAMISAFECVHDGWGVAVLVGVPNRDDSFKTHPINLLNERTLKGTFFGNFKPRTDLPRLVEKYVNKELDLQLEKFITHEVSFSDINKAFDYMLKGEGLRCIIRMGA

SEQ ID NO: 27312 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 27313 - protein, 184 aa, Candida albicans
MSEDKLQKLQDSGLVDWAVFSEIVTMDEDEEGFSKSLVEVFVSQVEETFEEIDKYLKEKNLEKLSSSGHFLKGSAAALGLTKISNQCERIQNYGHKINFDNFQLEDIKTKGDSAVSAENVAVNDGETNPENGSNGNETSNNKTNTSNIPDESSDDFWIALIEDALAKARDGFDQSRRALDEYYE

SEQ ID NO: 27314 - protein, 243 aa, Methanosarcina thermophila
MRIREDIETVFKKDPAARSTLEVICCYPGLHAIWIHRVSHSLWNRHFYFLARLLSHISRMLTGIEIHPGAKLGRRVFIDHGSGVVIGETAEVGDDVLIYMGVVLGGTTLEKKKRHPTIENDVVIGSGATVLGPITVGRGAKIGAGSVVIRPVPPGATVVGVPARIAEPRPSPSAGQLDHDKLPDPGLIVIGQILDRLSRLEDQFKAHEKSISREEKTTQEAALKDEQIYSLLKEVIDPGVGMD

SEQ ID NO: 27315 - protein, 442 aa, Streptomyces coelicolor
MVSAAEPKRTRKSVAAKSPAKRTATKAVAANPVTSRKATAPAAPAAPATEPAAVEEEAPAKKAAAKKTTAKKATAKKTTAKKAAAKKTTAKKEDGELLEDEATEEPKAATEEPEGTENAGFVLSDEDEDDAPAQQVAAAGATADPVKDYLKQIGKVPLLNAEQEVELAKRIEAGLFAEDKLANSDKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 27316 - protein, 52 aa, Streptomyces coelicolor
EGNAGLVRAVEKFDYRKGFKFSTYATWWIRQAITRSIADHSRTIRLPVHLVE

SEQ ID NO: 27317 - protein, 756 aa, Mus musculus
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGGPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASASRRGTTKSPGPSRRSKSPASTSSVNGTPGSQLSTPRSGKSPSPSPTSPGSLRKQRISQHGGSSTSLSSTKVCSSMDENDGPGEGDELGRRHSLQRGWRREESEEGFQIPATITERYKVGRTIGDGNFAVVKECIERSTAREYALKIIKKSKCRGKEHMIQNEVSILRRVKHPNIVLLIEEMDVPTELYLVMELVKGGDLFDAITSTSKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELINMMLLVNVDQRFSAVQVLEHPWVNDDGLPENEHQLSVAGKIKKHFNTGPKPSSTAAGVSVIATTALDKERQVFRRRRNQDVRSRYKAQPAPPELNSESEDYSPSSSETVRSPNSPF

SEQ ID NO: 27318 - protein, 2549 aa, Mus musculus
MLGTGPAVATASAATSSNVSVLQQFASGLKSRNEETRAKAAKELQHYVTMELREMSQEESTRFYDQLNHHIFELVSSSDANERKGGILAIASLIGVEGGNSTRIGRFANYLRNLLPSSDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQPNALVGLLGYSSPQGLMGFGTSPSPAKSTLVESRCCRDLMEEKFDQVCQWVLKCRSSKNSLIQMTILNLLPRLAAFRPSAFTDTQYLQDTMNHVLSCVKKEKERTAAFQALGLLSVAVRSEFKVYLPRVLDIIRAALPPKDFAHKRQKTVQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVASITLALRTLGSFEFEGHSLTQFVRHCADHFLNSEHKEIRMEAARTCSCLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSQGRIVSIKLLAAIQLFGANLDDYLHLLLPPIVKLFDAPEVPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSSQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAASGVLEYAMKHFGELEIQATWYEKLHEWEDALVAYDKKMDTNKEDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTAHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAASAAAATSTEGSNSESEAESNENSPTPSPLQKKVTEDLSKTLLLYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRTTCHTVMEVLREHKDSVMAVLEAFVYDPLLNWRLMDTNTKGNKRSRTRTDSYSAGQSVEILDGVELGEPAHKKAGTTVPESIHSFIGDGLVKPEALNKKAIQIINRVRDKLTGRDFSHDDTLDVPTQVELLIKQATSHENLCQCYIGWCPFW

SEQ ID NO: 27319 - protein, 1544 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPVTGASGVPENSPPCTVNIPIAPIHSSAQAMSPTQSIGLVQSLLANQNVQLDVLTNQTTAVGTAEHAGDRCHPVTQVSNRYSNPGQVIFGSVEMGRIIQNPPPLSLPPPPQGPMQLSTVGHGDRDHEHLQKSAKALRPTPQLAAEGDAVVFSAPQEVQVTKINPPPPYPGTIPAAPTTAAPPPPLPPPQPPVDVCLKKGDFSLYPTSVHYQTPLGYERITTFDSSGNVEEVCRPRTRMLCSQNTYTLPGPGSSATLRLTATEKKVPQPCSSATLNRLTVPRYSIPTGDPPPYPEIASQLAQGRGAAQRSDNSLIHATLRRNNREATLKMAQLADSPRAPLQPLAKSKGGPGGVVTQLPARPPPALYTCSQCSGTGPSSQPGASLAHTASASPLASQSSYSLLSPPDSARDRTDYVNSAFTEDEALSQHCQLEKPLRHPPLPEAAVTLKRPPPYQWDPMLGEDVWVPQERTAQTSGPNPLKLSSLMLSQGQHLDVSRLPFISPKSPASPTATFQTGYGMGVPYPGSYNNPPLPGVQAPCSPKDALSPTQFAQQEPAVVLQPLYPPSLSYCTLPPMYPGSSTCSSLQLPPVALHPWSSYSACPPMQNPQGTLPPKPHLVVEKPLVSPPPADLQSHLGTEVMVETADNFQEVLSLTESPVPQRTEKFGKKNRKRLDSRAEEGSVQAITEGKVKKEARTLSDFNSLISSPHLGREKKKVKSQKDQLKSKKLNKTNEFQDSSESEPELFISGDELMNQSQGSRKGWKSKRSPRAAGELEEAKCRRASEKEDGRLGSQGFVYVMANKQPLWNEATQVYQLDFGGRVTQESAKNFQIELEGRQVMQFGRIDGSAYILDFQYPFSAVQAFAVALANVTQRLK

SEQ ID NO: 27320 - protein, 972 aa, Gallus gallus
MDFRANLQRQVKPKTLSEEERKVHAPQQVDFRSVLAKKGTPKTPLPEKVPPPKPAVTDFRSVLGAKKKPPAENGSASTPAPNARAGSEAQNATPNSEAPAPKPVVKKEEKNDRKCEHGCAVVDGGIIGKKAENKPAASKPTPPPSKGTAPSFTEKLQDAKVADGEKLVLQCRISSDPPASVSWTLDSKAIKSSKSIVISQEGTLCSLTIEKVMPEDGGEYKCIAENAAGKAECACKVLVEDTSSTKAAKPAEKKTKKPKTTLPPVLSTESSEATVKKKPAPKTPPKAATPPQITQFPEDRKVRAGESVELFAKVVGTAPITCTWMKFRKQIQENEYIKIENAENSSKLTISSTKQEHCGCYTLVVENKLGSRQAQVNLTVVDKPDPPAGTPCASDIRSSSLTLSWYGSSYDGGSAVQSYTVEIWNSVDNKWTDLTTCRSTSFNVQDLQADREYKFRVRAANVYGISEPSQESEVVKVGEKQEEELKEEEAELSDDEGKETEVNYRTVTINTEQKVSDVYNIEERLGSGKFGQVFRLVEKKTGKVWAGKFFKAYSAKEKENIRDEISIMNCLHHPKLVQCVDAFEEKANIVMVLEMVSGGELFERIIDEDFELTERECIKYMRQISEGVEYIHKQGIVHLDLKPENIMCVNKTGTSIKLIDFGLARRLESAGSLKVLFGTPEFVAPEVINYEPIGYETDMWSIGVICYILVSGLSPFMGDNDNETLANVTSATWDFDDEAFDEISDDAKDFISNLLKKDMKSRLNCTQCLQHPWLQKDTKNMEAKKLSKDRMKKYMARRKWQKTGHAVRAIGRLSSMAMISGMSGRKASGSSPTSPINADKVENEDAFLEEVAEEKPHVKPYFTKTILDMEVVEGSAARFDCKIEGYPDPEVMWYKDDQPVKESRHFQIDYDEEGNCSLTISEVCGDDDAKYTCKAVNSLGEATCTAELLVETMGKEGEGEGEGEEDEEEEEE

SEQ ID NO: 27321 - protein, 530 aa, Brassica napus
MGDSTGEPGSSMHGVTGREQTFAFSVASPIVPTDKTAKFDLPVDSEHKATVFKLFSFAKPHMRTFHLSWISFSTCFVSTFAAAPLVPIIRENLNLTKQDIGNAGVASVSGSIFSRLVMGAVCDLLGPRYGCAFLVMLSAPTVFSMSFVSGAAGFITVRFMIGFCLATFVSCQYGMSTMFNSQIIGLVNGTAAGWGNMGGGITQLLMPVVYEIIRRCGATAFTAWRLAFFVPGWLHIIMGVLVLNLGQDLPDGNRSALEKKGEVAKDKFGKIMWYAVTNYRTWIFVLLYGYSMGVELSTDNVIAEYFFDRFHLKLHTAGIIAACFGMANFFARPAGGYASDLAAKYFGMRGRLWALWIIQTAGGVFCVWLGRANTLVTAVVAMVLFSLGAQAACGATFAIVPFVSRRALGIISGLTGAGGNFGSGLTQLIFFSTSRFTTEQGLTWMGVMIVACTLPVTLIHFPQWGSMFLPPSTDPVKGPKEHYYASEWNEQEKEKNMHQGSLRFAKNAKSEGGRRVRSAATPPENTPNNV

SEQ ID NO: 27322 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 27323 - protein, 160 aa, Zymomonas mobilis
MVSVISTFSPFPLPEPMRQALLQAESAAHQGEVPVGAVVTFKGKIIAVAGNAMQPPFIDPTGHAEVRALRQAASVLGSSRLDQCDLWVTLEPCAMCAGAIATARIRRLYYGADDPKGGAVLSGVRLFFQPSCHHQPEIYNDLGSRKASELLRQFFKQKRK

SEQ ID NO: 27324 - protein, 251 aa, Zymomonas mobilis
MRFQDKIVVITGGGNGMGKAAAERFSSEGAIVVLADWQIKDAEEVAASLPKDRAWPYKIDVSDPDAVKKMMDDIAAKYGKIDVLVNNAGILIPGKIMDASIEDWKKISSVNIDGVIYCAKFAMPYLVKSKGCIVNTASVSGLGGDWGMVYYCTTKGAVVNFTRALALDSGVNGVRVNSVCPCIVKTKMAANWPESAQAQFKNRVSLGRIPEAEEIASVMAFLASDDARFITGVNLPVDGGATASDGQPHLG

SEQ ID NO: 27325 - protein, 1291 aa, Lampetra fluviatilis
MALSKGFRVLQKNEQNLYSVILESRNREECLLFESGAIAVLSAAEEEAVKGQYNRLMDAYGCLGMLRLNMDGKGEVILRYLVLVTGCASVDHIVDSEVMRITSVEMVSLQGDPSDEDRVADLRRLLSTGTFYFSSSGGVGNTYDLSVRAQLQGQGDPAQHNPFCWNAALHVPLRQCGVGCGAWLLRVVCGGVGVRTLYAAHQQAKVCVLARVSCARAGTRFNVRGADDSGQVANFCETEQIIFIDDEVTSFVQLRGSVPLFWEQPGLQVGSHRVKMSRGYEANAPALDRHFAMLKELYGKQMVVNLLGSKEGEHMLSKAFQSHMQASRHASDIPMLNFDYHLLLKGSSQRSERLQSGLGTKVRPFLEQCGFYCFHEGVVSRVQKGTVRTNCLDCLDRTNSVQTHFAVDMLKRQLEDLGLAEKPQMVARFDEVFRSLWSAVGDLVSKMYAGTGALEGKTKLKDGARSVTRTIQNNFFDGAKQEAMDLLLLGCVLNSEAADKARTLITPTTRGAENFLQTASVRLLRSLCERHGEYTHPKRLRVAIATWNVNGGKTMRSIAFKHQTLSDWLLDNHKQAAISTFQDDTPVDVFAIGFQEMVELNAGNIVSASTENQKRWSVELQKTISRDHKYILVTSEQLVGVCLFVFLRPHHAPHVRDVAVDTVKTGMGGATGNKGGVAIRLQMYSSSLCFVCSHFAAGQSHTRERNEDYAEIARKISFPMGRGLFSHDYVFWCGDFNYRIDLSGDEVKELVRQKNWETLQQADQLVQQRNLSAVFRGFHEGRTNFPPTYKYDIFSDDYDTSEKCRIPAWTDRVLWYRHKWAFEKSADELDLLNLPAGGEPRLPHLWNPGTLIHYSRAELKTSDHRPVIALIDVDLLEVTPGSMQGVLRAAIAAHGPPDASAVLSLDSGEEFDDACIEQLLRILAGYGDVTLVRFAGNDMVVTFRDSRSALEILCINGIQVLRHILHVRLKSPEWSSMLEEELVQSAGDMQATGAMLTHNSSLLEDDASLPPAYYAIEDEQDDMADAEEGGMQDQLTSGMAVDPSVSPRPSPKPSPCPSPTHGEGRDWQSFGKQTSESLSKPAGPPAKPPPPQRPPPPSVKSQPAPGSTILQPTSAPRSQDMPRVPSRPPPPLPATPPQHRSAAVASSSPEIAKSRAPVNLPEPLLPSAAAPSPQNLSQPSPSLPEPMLPQLVHSNQIQQLLIPMLPIQTTAPSPLPEAMLPSPAASPPMQEPMVPSPSTQAQFLDTQPPSPSTQGLLQATGTSSAPQAPPRNRSTQSIPHAEAPVPLKPPE

SEQ ID NO: 27326 - protein, 231 aa, Mus musculus
MAGKKVLIVYAHQEPKSFNGSLKKVAVEELSKQGCTVTVSDLYSMNFEPRATRNDITGAPSNPDVFSYGIETHEAYKKKALTSDIFEEQRKVQEADLVIFQFPLYWFSVPAILKGWMDRVLCRGFAFDIPGFYDSGFLKGKLALLSLTTGGTAEMYTKDGVSGDFRYFLWPLQHGTLHFCGFKVLAPQISFGLDVSSEEERKVMLASWAQRLKSIWKEEPIHCTPPWYFQE

SEQ ID NO: 27327 - protein, 249 aa, Streptomyces collinus
MELALHGRKLLITGGTRGIGRGIVLAAARAGADVLTCYRQESEAVDSLTAALKETAGDHHVIRADVGDTAEADRLVGEAKDRFGRLDGVVNNAGVISHIPFGELPADEWSRILDTNLTAAYRIIHQALPLLGTGSSVVNIGSRGAAAGIPLRAHYTAAKAAMIGLTRSLAKELGPKGIRVNVVAPGVIETEAFADMPAERAAGLRATYSQKTALARLGTVEELAGPVLFLLSDAAAYITGETLNVDGGI

SEQ ID NO: 27328 - protein, 226 aa, Ipomoea batatas
MAGNDWINSYLEAILDVGRGIDDAKSSLLLRERGRFSPTRYFVEEVITGFDETDLHRSRVRAQATRSPQERNTRLENMCWRIWNLARQKKQLEGEQAQRLAKRRQERERGRREAVADMSEDLSEGEKGDAISDISAHGESIKGRLPRISSVETMESWANQQKGKKLYIVLISLHGLIRGENMELGRDSDTGGQVKYVVELARALGSMPGVYRIDLLTRQVSSPEVD

SEQ ID NO: 27329 - protein, 432 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 27330 - protein, 364 aa, Solanum tuberosum
MDRVKGPWSPEEDELLQQLVQKHGPRNWSLISKSIPGRSGKSCRLRWCNQLSPQVEHRAFTPEEDETIIRAHARFGNKWATIARLLNGRTDNAIKNHWNSTLKRKCSSLSADEGNELADQIFENQQPPLKRSVSAGSAMPVSGFHFSPGSPSGSDSDSSLHVTSSSQSHVFKPVARTGGVFPQSIDISSPPVDPPTSLSLSLPGVDLAEFSNRSADSTQSKNPFQLLLPPMQIPPPPPPPPPPPPQATTVPFERVSAIQQSLQNPDFGKNAGGEQPDKVFVPFSQELLGVMQEMIKTEVRNYMMGVEQKQQFQQQQQHYQQQPQQFQQQNHQLPSGLGLGLCMQQASDGFRDRAANRMRLSKFD

SEQ ID NO: 27331 - protein, 306 aa, Solanum tuberosum
RIKGPWSPEEDELLQTLVEKHGPRNWTLISKSVPRRSGKSCRLRWCNQLSPQVEHRAFTPEEDDTIIRAHAKYGNKWATIARLLSGRTDNAIKNHWNSTLKRKCPSMSEDLSFETPQPPLKRSSSVGPCTNFSSVMNPGSPSGSDLSDSSLSGFPQPLVYRPVPRTGGIFPLPPPVKQIEIPPSVPDPPTSLCLSLPGSGSIEKPTQSPKSPPLPPPPLPVVDKPIPPSAAVMGHLPRSNQSYDFCAAPKSGEKQFFTPEFLSVLQDMIRKEVKSYMSGFEQNGICMQTDAIRNAVIKRIGISKIE

SEQ ID NO: 27332 - protein, 255 aa, Solanum tuberosum
MDFFNRCSTSSSSSESSSSESSLSGKNPNKSERIKGPWSAEEDKILTKLVERYGARNWSLISKYIKGRSGKSCRLRWCNQLSPNVEHRPFSPAEDEAILAAHAKYGNRWATIARLLPGRTDNAVKNHWNSTLKRRYQQLIQQQNQNPIGFSDLKINGSGSGSGSGFGSCMEYLNADESPKGNSNNNNNNNYAVTNNCSGEFDDPMTTLSLAPPGMGGDELPEKKTESFPEGFWDVVRGVIAREVREYVASTGFPN

SEQ ID NO: 27333 - protein, 215 aa, Solanum tuberosum
MKDKEVKTRMKRGFWKPEEDLILKNCVETHGEGNWATISEKSGLMRSGKSCRLRWKNYLRPNIKRGMMSEDEKDLIIRLHKLLGNRWSLIAGRLPGRTDNEVKNFWNTHLNNKRSCRGKKKHVKSKEANTQSTQGKMQEYPAETVSNQEVATKTVLDSWIEEMQDFNCSLLSPLTMNNMPFLEDEPFIPILDDIVLLEAFTSTGKEAWNEIQPFL

SEQ ID NO: 27334 - protein, 326 aa, Candida albicans
MTGSSSQFQQLEKLGEGTYATVYKGRNRATGALVALKEISLDSEEGTPSTAIREISLMKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQHPHQPIIDQQY

SEQ ID NO: 27335 - protein, 176 aa, Homo sapiens
MADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 27336 - protein, 233 aa, Spinacia oleracea
  unsure (1)..(233): unsure at all Xaa locations
XVAQTSEWEQEGSTNAVLEGESDPEGAVSWGSETQVSDEGGVEGGQGFSEPPEEAKLFVGNLPYDVDSEKLAGIFDAAGVVEIAEVIYNRETDRSRGFGFVTMSTVEEAEKAVELLNGYDMDGRQLTVNKAAPRGSPERAPRGDFEPSCRVYVGNLPWDVDTSRLEQLFSEHGKVVSARVVSDRETGRSRGFGFVTMSSESEVNDAIAALDGQTLDGRAVRVNVAEERPRRAF

SEQ ID NO: 27337 - protein, 283 aa, Physcomitrella patens
MGRGKIEIKKIENTTSRQVTFSKRRGGLLKKAHELAVLCDAEVALVIFSSTGKLFEYASSGSMRDIIERYKKSPNGAMKSGASTDFLGREVVKLQEQVERLKSSQRRMLGEDLSALKVPDLLQLEQQLDLGASRVRARKNQLILEEIEGLQKKEQELMVANEDLRKKIADAEAVARANLSEARPESPRHLARTLSRDVSASSHPAATVYPHPNLRDVQRSQTSLQLGMFSSESYPPSSSRWPSEQQFPSASEGCAGESSMKWDHPHYHIQNRLHANILPSVRI

SEQ ID NO: 27338 - protein, 284 aa, Physcomitrella patens
MGRGKIEIKKIENTTSRQVTFSKRRGGLLKKAHELAVLCDAEVALVIFSSTGKLFEYASSGSIRDIIDRYKKGSDGMQNGARNDFMGCEVVKLREQLEQLKASHRHMLGEDLSLLKVPDLLQLEQQLDLGASRVRARKNQLILEEVESLRRKEHELLIANEDLRQKLADAQGIADAVTARANVSESPRPLTSALTRDIVMSSQQQEVTVHPHPNLRDAQRSQTSLQLGMFSSESYLPSSSRGPSEHPIPVGPEGCAGESAMRWEHPHFHSQNRLHANISPSVRI

SEQ ID NO: 27339 - protein, 518 aa, Polyporus ciliatus
MARFQSLLSFVTLLFAVSAYAAIGPVTDLTVTDANISPDGFNRAAVVVNGVFPAPLITGQKGDRFQLNLVNQMTNHTMLKTTSIHWHGFFQKGTNWADGPAFVNQCPIASGNSFLYDFQVPDQAGTFWYHSHLSTQYCDGLRGPFVVYDPADPHLGLYDVDDDSTVITLADWYHVAAKLGPRFPPSSDSNLINGLGRSPSTPTADLAVISVTQGKRYRFRLVSISCDPNYTFSIDGHQLTVIEADGISTQPVTGIDSIQIFAAQRYSFVLTADQPVDNYWVRANPNFGNTGFAGGINSAILRYDGAPAIEPTTNQTGTNLLLETDLHPFTPTPVPGNPTQGGADFNLNLAFNFNGTDFSINGATFTPPSVPVLLQIISGANSAQDLLPSGSVYALPSNSSIELTFPATAAAPGAPHPFHLHGHAFAVVRSAGSTVYNYDNPVYRDVVSTGTPGDNVTIRFQTDNPGPWFLHCHIDFHLDAGFAVVFAEDIPDVASANPVPQAWFDLCPIYNALDPSDQ

SEQ ID NO: 27340 - protein, 524 aa, Polyporus ciliatus
MSKFQSLVAFVALTLATSRLAAAAIGPVADLTITNADINPDGFTRAAVLANNVFPGPLITGNKGDNFQLNVVDNLSNDTMLTATTIHWHGFFQKGTNWADGPAFVNQCPISTGNSFLYNFNAPDQAGTFWYHSHLSTQYCDGLRGPMVVYDDADPHASLYDVDDESTVITLADWYHTAARLGPCFPLGSDSTLINGLGRFAGGDADAPLTVISVTSGKRYRFRLISISCDPNFTFTIQGHTMTVIEVDAVNVQPYEVDSIQIFAGQRYSFVLTADQAVDNYWIQAIPSIGTITTDGGVNSAILRYDGADIVEPAAATVTGSNPLVETSLVPLENLAAPGEPTIGGVDYPLNLDFSFDGTNFAINGATFTPPTVPVLLQIMSGAQDVADLLPSGSIYSLPSNATIELSFPITATNAPGAPHPFHLHGHTFYVVRSAGSTEYNYVNPPQRDTVSTGTAGDNVTIRFTTNNPGPWFLHCHIDFHLEAGFAVVFGEDIPSISDANPPSSAWEDLCPTYNSVYPNGDGN

SEQ ID NO: 27341 - protein, 477 aa, Polyporus ciliatus
AVVVNGQFPGPLVTGNKGDNFQINVIDQLTNNTMLKSTTVHWHGFFQKGTNWADGPAFVNQCPISTGNSFLYDFTAADQAGTFWYHSHLSTQYCDGLRGPMVVYDPNDPHASLYDVDDESTVITLSDWYHTAAKLGPAFPLGPDSVLINGLGRFAGGDANADLAVISVTQGKRYRFRLVSISCDPNFVFSIDKHNMTVIEADAVSHEPVTVDSIQIYAGQRYSFVLTADQAIDNYWIRALPSGGTVNFDGGVNSAILRYDGAAEIEPVTNRTMSMAPLVESDLVPLDNPAAPGDASIGGVDYALNMAFSFNGTNFFVNGATFVPPTVPVLLQIMSGAQSATDLLPGGSVYSLPSNATIELSFPITATNAPGAPHPFHLHGHVFSVVRSAGSSEYNYVNPPRRDVVNTGTAGDNVTIRFTTDNPGPWFLHCHIDFHLEAGFAVVFSEDSSSGGDSDLSSNDAWNNLCPTYDALSADDL

SEQ ID NO: 27342 - protein, 500 aa, Lycopersicon esculentum
MPEIERHRTRHNRPAIREPVKPRVPLRLLLRVASVAGGIQFGWALQLSLLTPYVQELGIPHAWASIIWLCGPLSGLLVQPLVGHMSDKCTSRFGRRRPFIVAGAASIMIAVLIIGFSADIGWLLGDRGEIKVRAIAAFVVGFWLLDVANNMTQGPCRALLADLTQKDHRRTRVANAYFSLFMAIGNILGFATGSYSGWYKIFLFTLNTACTINCANLKAAFILDIIFIATTTCISISAANEQPLDPSRGSSHTGEEIDESSHGQEEAFLWELFGIFKYFPGVVWVILLVTALTWIGWFPFLLFDTDWFGREIYGGEPNDGKNYSAGVRMGSLGLMLNSVLLGLTSLFMEKLCRKWGAGFTWGVSNVVMSLCFIAMLIITAVRSNIDIGQGLPPDGIVIAALVVFSILGIPLAITYSVPYALVSSRIEALGLGQGLSMGVLNLAIVFPQIVVSLGSGPWDELFGGGNSPAFVVAALSAFAAGLIAILAIPRTRVERPKIFA

SEQ ID NO: 27343 - protein, 359 aa, Giardia intestinalis
MEDIQVEAYPELSYKDLRHIKNIGSGSFGRVTLAQHIDTGKYYAVKAMSKRKIIALRQVAHINNECSILRVVRSPFIIRQYGTYQDDKNVYIILDFIQGGELFYHLRRYNKFPLQVVKFFAVEILLALGYLHNLGIAYRDLKLENVLVDNTGHIKLADLGFAKRLVEKNADGDTVSQLTFSIVGTPEYLAPEIIRSTGHDMSADWWAFGVLIYEMLTGSPPFFDDNPDMTCKKILGGKITFASGFDKAAKDLIIRLLNPDKTRRLGASINNGTADIMKHAFFSGVNCLGLRKKSGRHPIVPKLTDPADTANYEDYLDENGNFEEDEIDYENLRSDAAELGLAEIPGTQEEKDALFVGFK

SEQ ID NO: 27344 - protein, 307 aa, Trypanosoma brucei rhodesiense
MTDKKREPAPKLGFLEEFMIGGVAAGLSKTAAAPIERVKLLVQNQGEMMKQGRLDKPYNGVVDCFRRTISTEGVYPLWRGNLSNVLRYFPTQALNFAFKDKFKRMFNYKKEKDGYGKWFMGNMASGGLAGAASLCFVYSLDYVRTRLANDTKSVKGGGERQFNGIVDCYVKTWKSDGIAGLYRGFVVSCIGIVVYRGFYFGLYDTLQPMLPVDTFIVNFFLGWAVTIVAGLLSYPLDTVRGRMMMTSGAAVKYKNSMDCMLQVIKQEGAASLMRGAGANILRGIAGAGVLSGVDALKPIYVEWRRSN

SEQ ID NO: 27345 - protein, 166 aa, Xenopus laevis
MSDEGKLFIGGLNFETNEGCLEQAFTKYGRISEVVVVKDRETKRSRGFGFVTFENVDDAKDAMMAMNGKSVDGRQIRVDQAGKSSGERRGGYRGGSSGGRGFFRGGRGRGGGDRGYGSSRFDNRSGGYGGSSGSRDYYGSGRSQGSYGDRSGGSYRDSYDSYATHE

SEQ ID NO: 27346 - protein, 240 aa, Zea mays; identical to SEQ ID NO: 5704

SEQ ID NO: 27347 - protein, 280 aa, Streptococcus agalactiae
MTDTMILNDNHKIPTLGLGTWMIDNDRVAQVVKDAIELGYRHINTAQAYNNEKGVGVGIKESGITRESLFVTTKIAAEHKDYESATKSIDQSLEALGLDCIDLMIIHSPQPWKEWRETDKHFDQGNLEAWRALEDAQKSGKVKSIGVSNFLEKDLKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSEK

SEQ ID NO: 27348 - protein, 498 aa, Acinetobacter sp. SE19
MGGIPHIPFCLTSVICQGCLIMNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 27349 - protein, 251 aa, Acinetobacter sp. SE19
MEKIMSNKFNNKVALITGAGSGIGKSTALLLAQQGVSVVVSDINLEAAQKVVDEIVALGGKAAANKANTAEPEDMKAAVEFAVSTFGALHLAFNNAGILGEVNSTEELSIEGWRRVIDVNLNAVFYSMHYEVPAILAAGGGAIVNTASIAGLIGIQNISGYVAAKHGVTGLTKAAALEYADKGIRINSVHPGYIKTPLIAEFEEAEMVKLHPIGRLGQPEEVAQVVAFLLSDDASFVTGSQYVVDGAYTSK

SEQ ID NO: 27350 - protein, 261 aa, Bacillus licheniformis
MYPSLEGKTVVITGAGTGLGKAMALRFGAEKANVVINYFKEEENPEETVEKIESSGARAIAVQGDVSKEDDVKALIRQAVDSFGSVDVMVNNAGVENEVPSEDLALEDWNRVISTNLTGMFLGCREAIGYMLDHNIKGSVINMSSVHQQIPWPHFVHYAASKGGAKLLTETLALEYAPKGIRVNAIGPGAIDTPINAEKFADPELKKGVIELIPIGYIGKPEEVAACAAWLASEEASYVTGLTLYVDGGMTKYPGFQAGKG

SEQ ID NO: 27351 - protein, 379 aa, Arabidopsis thaliana
HQVQHPTIAQKAAGQFMRSSVSKDVQVGYQRPSMYQRHATYGNYSNAAFQFPPTSRMLATTASPVFVQTPGEKGFTNFALDFLMGGVSAAVSKTAAAPIERVKLLIQNQDEMIKAGRLSEPYKGIGDCFGRTIKDEGFGSLWRGNTANVIRYFPTQALNFAFKDYFKRLFNFKKDRDGYWKWFAGNLASGGAAGASSLLFVYSLDYARTRLANDAKAAKKGGGGRQFDGLVDVYRKTLKTDGIAGLYRGFNISCVGIIVYRGLYFGLYDSVKPVLLTGDLQDSFFASFALGWVITNGAGLASYPIDTVRRRMMMTSNEAVKYKSSLDAFKQILKNEGAKSLFKGAGANILRAVAGAGVLSGYDKLTLIVFGKKYGSGGA

SEQ ID NO: 27352 - protein, 357 aa, Homo sapiens
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCAYVAKPESLS

SEQ ID NO: 27353 - protein, 268 aa, Acinetobacter sp. M-1
MRIPQFGLGTFRLKDQAVIDSVKTALEVGYRAIDTAQVYENEAAVGQAIAESGVARQDLFLTTKIWVDNFAEDKFIPSLKDSLQKLRTDAVDLTLIHWPAPALGVSIPSVMQLLLEAKQQGLTKQIGISNFNIALTQQAIDSIGIEHIATNQIELSPYLQNRNLVNYLREQNIDVTSYMTLAYGKVLQDPTLIEIAAQHQATTAQVALAWALQNGFAVIPSSTKRENLISNLKAQDLTLSAEEMQLIAQLERNGREVSPEPFAPEWDK

SEQ ID NO: 27354 - protein, 261 aa, Streptomyces antibioticus
MSQAVKPVALVTGATSGIGLEIARRLAGLGARVYLCARHEDQLADTIKELTDAGYEVDGTTCDVSDPEQIRAFVRAAVDRFGPVDILVNNAGRSGGGATNEIPDDLWFDVINTNLNSVFLMTKEVLNTGGMLAKKSGRIISIASTGGKQGVVHAAPYSASKHGVVGFSKALGLELARTGITVNAVCPGFVETPMAERVREHYAGIWGVSEQETHDRITTRVPLGRYVETREVAAMVEYLVSDDAAAVTAQALNVCGGLGNY

SEQ ID NO: 27355 - protein, 402 aa, Listeria monocytogenes
MLKKFIIQSRMPTTKPFIPTQMNQPLPKDFSISADDKKKLESGETVSKKIDNRFNKEMTIVYVPIMNGDKFVGSIVLNSPISGTEQVIGTINRYMFYTILLSITVALILSAILSKLQVNRINKLRAATKDVIQGNYHARLKENNFDEIGALAIDFNKMTQTLEHLKKKLNDKRNGDAQFIADVSHEMRTPLTTISGLTEGLVNDIIPKSETDRCIALIDTEARRLTKLVNENLDYEKIRSNKIKLQKTRFNGKEFLELIKEQVDYVASEKGNTITVAIDKDMAIYADYDRLTQVFINIVKNSVQFTENGQITLTGTQDYKESVLTITDTGIGMNTEELEQIWERFYKADMSRTNTAFGESGIGLSIVKQLIEYHDGSITVTSEPNKGTSFTIRLPFFQDNEQ

SEQ ID NO: 27356 - protein, 417 aa, Arabidopsis thaliana
MAASAATTTSSHLLLSSSRHVASSSQPSILSPRSLFSNNGKRAPTGVRNHQYASGVRCMAVAADASETKTAARKKSGYELQTLTGWLLRQEMKGEIDAELTIVMSSISLACKQIASLVQRAGISNLTGVQGAINIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 27357 - protein, 588 aa, Brassica napus
MSLPETKSQTLLDAWDFQGRPADRSKTGGWASAAMILCIEAVERLTTLGIGVNLVTYLTGTMHLGNATAANTVTNFLGTSFMLCLLGGFIAHTFLGRYLTIAIFAAIQATGVSILTLSTIIPGFQPPRCPTTSSHCVQPSGIQLTVLYLALYLTALGTGGVKASVSGFGSDQFDETEPKEQSQMTYFFNRFFFCINVGSLLAVTVLVYMQDDVGRKWGYGLCALAIVLSLSIFLAGTNRYRFKKLIGSPMTQVAAVIVAAWWNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 27358 - protein, 488 aa, Coptis japonica
MEVLSIAIVSFSFLLFLFFILRDSRPKNLPPGPRPSPIVGNLLQLGDKPHAEFAKLAQKYGELFSLKLGSQTVVVASSPAAAAEILKTHDKILSGRYVFQSFRVKEHVENSIVWSECNDNWKLLRKVCRTELFTPKMIESQSEIREAKAREMVKFLRGKEGEVVKIVEVVFGTLVNIFGNLIFSKDVFDLEDPTGGSVELKEHLWKLLDMGNSTNPADYFPIMGKLDLFGQRRAVAEVLQQIYDVWGVMLKERRGTKGSESKNDFVDVLLNAGLDDQKINALLMELFGAGTETSASTIEWAITELTKKPLVVSKIRLELVNVVGDNTVKESDLPHLPYLQAFVKETLRLHPPTPLLLPRRALETCTVMNYTIPKECQIMVNAWAIGRDPKTWDDPLNFKPERFLSSDVDYKGNDFELIPFGGGRRICPGLPLASQFSNLIVATLVQNFEWSLPQGMSTSELSMDEKFGLTLQKDPPLLIVLKARASNI

SEQ ID NO: 27359 - protein, 337 aa, Lactuca sativa
MVALSKPSIEQFFMKPSKPNTNPLIFPTIPLIDLSKPESKQHLVKACQDFGFFKVVNHGVPTKFIKKLESEALKFFSSPLSTKEKAGPPDPFGYGNKRIGRNGDVGWVEYLLLNAKPESDYQRYLSVFEENPEIFQGVVNDYVTAVKKMACEILELLADEMKLQPRNVFSKLLMDEQSDSVFRVNHYLPCPEFQENERNGRKLVGFGEHTDPQIISVLRSNNTSGLEISLRDGSWMSVPADSDSFFINVGDSLQVMTNGRFKSVKHRVVANSTKSRVSMIYFGGPPLSEKIAPLPSLIQGEEDSLYKEFTWFEYKKSAFNTRLADNRLGLFEKITAT

SEQ ID NO: 27360 - protein, 338 aa, Lactuca sativa
MVMISQVEKKPVVDIFPTKSNKTNFTGIPVIDLSSPEDAKNLIVNACQDYGFFKVINHGVSPLLVSELENEAIEFFNMRQYEKDQYCPPNPFGYGRNKIGTNGDVGWIEYLLLTSTNFPTNSKIFSSLTNEYVKEVRKLGCTILELMAEGLKIEPKNVLSRMLSDENADTVFRLNHYPPCLDPNSNHDSDLNNKSMSHGRTSIGFGEHTDPQLISIARSNATSGFQIYLEDGTWVGVPPDETSYFINVDDLLEVMTNGRFRSVRHRVVADSFKSRVSMIYFGGPPLMEKISPLGSLMEPGEESLYNEFTWFEYKSCTYKTRLTDNRLSLFHKHSHPVH

SEQ ID NO: 27361 - protein, 725 aa, Tagetes erecta
MALCGALKGGFVPIAQNGYTSSSLLNPSANAIMPSNKRKFLGIVAVSKEHATNEHEDLTTMDKTTSTTLKYSGDKPKTPILDTINYPIHMKNLCVEELVKLADELREEIVYTVSKTGGHLSSSLGVVELTVSLHHVFNTPEDKIIWDVGHQAYPHKILTGRRSRMRTIRQTFGLAGFPKRDESNHDAFGAGHSSTSISAGLGMAVGRDLLGKNNHVIAVIGDGAMTAGQAYEAMNNAGYLDSNLIIVLNDNRQVSLPTATIDGPAPPVGALSRSLTRLQTSQKFRQLREAAKEVTKQLGDKTHEVAAKMDSLVKGMVGGQGASMFEELGLYYVGPVDGHNLEDLVYVFDKIKSMTAPGPVLVHIVTEKGKGYPPAEVAADKMHGVVKFDTQTGKQKKNKTKTLSYTQYFVDSLVAEAKEDDKIVAIHAAMGGGTGLNTFQKEFPARCFDVGIAEQHAITFAAGLATEGLKPFCAIYSSFLQRGYDQVVHDVDLQKLPVRFAMDRAGLVGADGPTHCGAFDTTFMACLPNMVVMAPSCEAELMNMVATAVAIDDRPSCFRYPRGNGIGSILPANNKGTLIEVGTGRVIKEGNRVALLGYGTIVQSCLAASEVLKKIGISVTVADARFCKPLDGNLIKQLANEHEVLITVEEGSIGGFSSHVSHFLALNGLLDGHLKWRAMMLPDRYIEHGAQSDQIEEAGLSSKHIAATVLSLIGGSKETLHALNV

SEQ ID NO: 27362 - protein, 333 aa, uncultured proteobacterium EBAC31A08
MKYDISALGNALVDTQYKVSHEFLSSVGLVADSMTLSSSEEQAPIISKLIEMGAESISDCGGSATNSLVAAANYGSNCHHVCRVSDDEDGRNYLDSLRSAGVKHIGVSSENTDQPTGKCLILVTPDAKRTMSSMLGVSAYLGKSDIDFDVVENSKIFYIEGYMVTSDDNFNAVISVLEHLKDKDVKKALSLSDAGIVHGFKEKFDLIESYGIDMIFCNDDEAVAFSGKESLDDAVSFYKEKPYMTAITKGADGSVVIDKGVEKHAQAEEITPIDTNGAGDMFAGSFMHAYLQGNNIEACAKFANYASSKVVETFGPRLSSDGYLKVLNKLKND

SEQ ID NO: 27363 - protein, 786 aa, Homo sapiens [sequence omitted]

SEQ ID NO: 27364 - protein, 554 aa, Brassica napus
MRGAKLLAACLYLAAAATLVVQAEDPYFHHVWNVTYGTASPLGVPQQVILINGQFPGPNLNSTSNNNVIINVFNNLDEPFLLTWNGIQHRKNCWQDGTPGTMCPIPAGTNYTYHFQPKDQIGSYFYYPTTAMHRAAGGFGGLRVNSRLLIPIPYDVPEDDYTVLIGDWYTKSHTQLKKFLDGGRTLGRPNGVLINGKAGKGDGSDAPLFTLKPGKSYRVRICNVGLKTSLNFRIQNHKMKLVEMEGSHVLQNDFDSLDVHVGQCFGTIVTANQEPKDYYMVASSRFLKSVITTTGLLRYEGGKGPASSQLPAGPVGWAWSLNQFRSFRWNLTSNAARPNPQGSYHYGKINITRTIKLVNTQGKVDGKLRYALNGISHTDLETPLKLAEYFGIADKVFKYNSVDNPTAEQTKSIKIEPHVLNITHRNFIEVVFENHEKSVQSWHLNGYSFFAVAVEPGSWTPEKRKNYNLLDAVSRHTVQVYPKCWAAILLTFDNCGMWNIASENTERRYLGQQLYVSVLSPEKSLRDEYNMPETSLQCGLVKNTPKPANPYAGA

SEQ ID NO: 27365 - protein, 555 aa, Brassica napus
MRGVKLLAACLYLAAAATVVVRAEDPYFHHVWNVTYGTASPLGVPQQVILINGQFPGPNINSTSNNNVIINVFNNLDEPFLLTWNGIQHRKNCWQDGTQGTMCPIMPGTNYTYHFQPKDQIGSYFYYPTTGMHRAAGGYGGLRVNSRLLIPVPYADPEDDYTVLIGDWFTKSHTQVKKFLDGGRTIGRPDGIVINGKAGKGDGSDAPLFTLKPGKTYRVRICNVGIKTSLNFRIQNHKMKLVEMEGSHVLQNDYDSLDVHVGQCYGTIVSANQEPKDYYMVASSRFLKKVITTTGLLRYEGGKGPASSQLPAGPVGWAWSLNQFRSFRWNLTASAARPNPQGSYHYGKINITRTIKLVNTQGKIDGKLRYALNGVSHTEPETPLKLAEYFGITDKVFKYDIITDDPTPEQIKNIKIEPNVLNITHRTFVEVVFENHEKSVQSWHLDGYSFFAVAVEPGTWTPEKRKNYNLLDAVSRHTVQVYPKCWAAILLTFDNCGMWNIRSENSERRYLGQQLYASILSPEKSLRDEYNMPETSLQCGLVKNTPKPVNPYAGA

SEQ ID NO: 27366 - protein, 555 aa, Brassica napus
MRGVKLLAACLYLAAAATVVVQAEDPYFHHVWNVTYGTASPLGVPQQVILINGQFPGPNINSTSNNNVIINVFNNLDEPFLLTWNGIQHRKNCWQDGTQGTMCPIMPGTNYTYHFQPKDQIGSYFYYPTTGMHRAAGGYGGLRVNSRLLIPVPYADPEDDYTVLIGDWFTKSHTQLKKFLDGGRTIGRPDGIVINGKSGKGDGSDAPLFTLKPGKTYRVRICNVGIKTSLNFRIQNHKMKLVEMEGSHVLQNDYDSLDVHVGQCYGTIVTANQEPKDYYMVASTRFLKKVITTTGLLRYEGGKGPASSQLPAGPVGWAWSLNQFRSFRWNLTASAARPNPQGSYHYGKINITRTIKLVNTQGKIDGKLRYALNGVSHTEPETPLKLAEYFGITDKVFKYDIITDNPTPEQIKNIKIEPNVLNITHRTFVEVVFENHEKSVQSWHLDGYSFFAVAVEPGTWTPEKRKNYNLLDAVSRHTIQVYPKCWAAILLTFDNCGMWNIRSENSERRYLGQQLYASVLSPEKSLRDEYNMPETSLQCGLVKNTPKPVNPYAGA

SEQ ID NO: 27367 - protein, 857 aa, Brassica oleracea
MKGARNIYHHSYMSFLLVFVVMILIHPALSIYINTLSSTESLTISSNKTLVSPGSIFEVGFFRTNSRWYLGMWYKKVSDRTYVWVANRDNPLSNAIGTLKISGNNLVLLDHSNKPVWWTNLTRGNERSPVVAELLANGNFVMRDSSNNDASEYLWQSFDYPTDTLLPEMKLGYNLKTGLNRFLTSWRSSDDPSSGNFSYKLETQSLPEFYLSRENFPMHRSGPWNGIRFSGIPEDQKLSYMVYNFIENNEEVAYTFRMTNNSFYSRLTLISEGYFQRLTWYPSIRIWNRFWSSPVDPQCDTYIMCGPYAYCDVNTSPVCNCIQGFNPRNIQQWDQRVWAGGCIRRTQLSCSGDGFTRMKKMKLPETTMATVDRSIGVKECKKRCISDCNCTAFANADIRNGGSGCVIWTERLEDIRNYATDAIDGQDLYVRLAAADIAKKRNASGKIISLTVGVSVLLLLIMFCLWKRKQKRAKASAISIANTQRNQNLPMNEMVLSSKREFSGEYKFEELELPLIEMETVVKATENFSSCNKLGQGGFGIVYKGRLLDGKEIAVKRLSKTSVQGTDEFMNEVTLIARLQHINLVQVLGCCIEGDEKMLIYEYLENLSLDSYLFGKTRRSKLNWNERFDITNGVARGLLYLHQDSRFRIIHRDLKVSNILLDKNMIPKISDFGMARIFERDETEANTMKVVGTYGYMSPEYAMYGIFSEKSDVFSFGVIVLEIVSGKKNRGFYNLDYENDLLSYVWSRWKEGRALEIVDPVIVDSLSSQPSIFQPQEVLKCIQIGLLCVQELAEHRPAMSSVVWMFGSEATEIPQPKPPGYCVRRSPYELDPSSSWQCDENESWTVNQYTCSVIDAR

SEQ ID NO: 27368 - protein, 162 aa, Medicago sativa
MQIQIAKQKQKNKKRNMGFTEKQEALVNSSFESFKQNPGYSVLFYTIILEKAPAAKGMFSFLKDSAGVQDSPKLQAHAGKVFGMVRDSAAQLRATGGVVLGDATLGAIHIQNGVVDPHFVVVKEALLKTIKESSGDKWSEELSTAWEVAYDALATAIKKAMS

SEQ ID NO: 27369 - protein, 114 aa, Medicago sativa
LEKAPAAKGLFSFLKDSAGVQHSPQLQAHAEKVFGLVRDSAVQLRATGGVVLGDATLGAIHVQKGVVDPHFVVVKEALLKTIKEAAGDKWSEELNTAWEVAYDALATAIKKAMS

SEQ ID NO: 27370 - protein, 113 aa, Medicago sativa
QNLPRYSVFFYTVILEKAPAAKGLFSFLKNSAEVQDSPQLQAHAEKVFGLVRDSAVQLRATGGVVLGDATLGAIHVRKGVVDPHFVVVKEALLKTIKEAAGDKWSEELTLLGK

SEQ ID NO: 27371 - protein, 341 aa, Leishmania mexicana
MNHTRSVMEAVLSVITYSFCSVSMILVNKLIMNTYDMNFPFGILVLQTGGAVVIVALAKAARFIDYPAFSFDVAKQWLPLTLLFVAMLFTSMKSLGTMSVAAQTILKNLAVVLIALGDRFLYGKAQTPMVYFSFALMILGSLLGAKGDRWVTAWGLVWTFLNIVSTVSYTLYMKAVLGSVSNSIGRYGPVFYNNLLSLPFFLIMGVGDMMPFSAAIGETTTFGRLVLAFSVLVSSVMTFSVFWCMSITSPTTMSVVGSLNKIPLTFLGMLVFHQFPTATGYLGILIALSAGFLYTHLNIRANHAKASSDTGHQMQQAGKPSAESIVLVRADEISKGTSKSE

SEQ ID NO: 27372 - protein, 121 aa, Medicago sativa
VLFYTVILEKALAAKGLFSFLKDSAGVQHSPQLQAHAEKVFGLVRDSAVQLRATGGVVLGDATLGAIHVQKGVVDPHFVVVKEALLKTIKEAAGDKWSEELNTAWEVAYDALATAIKKAMS

SEQ ID NO: 27373 - protein, 100 aa, Medicago sativa
KNSAEVQDSPQLQAHAEKVFGLVRDSAVQLRATGGVVLGDAALGAIHVRKGVVDPHFVVVKEALLKTIKEAAGDKWSEELNTAWEVAYDALATAIKKAMS

SEQ ID NO: 27374 - DNA, 12554 bp, artificial
  pMON93039
agcttgatctcgtcaatttttcccttttgtaattttgtaatttataatttactttcctgtatgcttctaactctgtcgttttaaaattttaataaaatttcagtaggggcttgcccctcctgtcctataaaaaaaagttgacgtgaatagatttcattaagaggttggatgttagtgggatgacatgactattagtaggacgagatgatgtggaaagttagtgggagatgatatggatagtttttgctttcatcgaaaggttggaagttagtatgatgacatggctaatatagatacatagatatagactaccaacatggctgcatgcccccaagctctcccactatatatatctctggtagcacatcatcccaattcacaatgcttacaaaaacccatccatcattttagctgttgatacaaaagagctcgaagggagatctaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttgatcccgatttggcaagtgttccagagcaaaagctggaagctctcgtagtctgagcctctttgctgattcatacaagttatgaccatctacatggatcgtctcaccaagaaatttgtagactgcaggatttttccctgaccggagtgcaccagctgggttccaactgaatttataggcaagcggattgtttgctgcagctggagatggcaatccaccacagtaagatgtaaatgcctttatttttccctttcgtgcatgagcttcatcaatcatcttcattgacatcaagtgatctatgccaggatctaggcccatttcacaaagtatagttacacctgcatctttggcagcttggctcaagtttgacatggattcatcaacatagcttgccgttaccatgtgcttcttcaactctatgcatactcctgcaatggcagcatgaaaactagcaggcagcaagctaattacaacctcaacctgagaaacaagatctgaaaggcttccaatatcagcaacatcaagctgggtagcagttgtattttcaataccatcaactgtctcttctgcatctttttgatacaaagatgccacgataacatgaatttgatctgcatcatggtcatcaacaccataggtacatatgtctgggtaagatgccagaaactcagcagctggccgacagactcttccagctccaaaccggtgctgcctgctagttttcatgctgccattgcaggagtatgcatagagttgaagaagcacatggtaacggcaagctatgttgatgaatccatgtcaaacttgagccaagctgccaaagatgcaggtgtaactatactttgtgaaatgggcctagatcctggcatagatcacttgatgtcaatgaagatgattgatgaagctcatgcacgaaagggaaaaataaaggcatttacatcttactgtggtggattgccatctccagctgcagcaaacaatccgcttgcctataaattcagttggaacccagctggtgcactccggtcagggaaaaatcctgcagtctacaaatttcttggtgagacgatccatgtagatggtcataacttgtatgaatcagcaaagaggctcagactacgagagcttccagcttttgctctggaacacttgccaaatcggaattaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcggatccatggtttcgccgacgaatctcctcccggcgcggaagatcacccctgtctcaaatggcggcgcagcgacggcgagcccctcttctccctcggtggccgcacggccacggcgactcccttcaggcctccaatctgtgactggtagagggaaggtttccttggcagccatcactagcacaggtttaacagctaagaccggagtagagcactttggcaccgtgggagtagcaatggtaactccattcacggaaagtggagacatcgatatagctgctggccgcgaggtcgcggcttatctagtcgataaaggcttggattctttggtgctcgcgggcaccactggtgaatccccaacgacaaccgccgctgagaaactagaactgctcaaggccgtgcgtgaggaagtaggggatagggcgaaactaatcgccggtgtcggaaccaataacacgcggacatctgtggaacttgcggaggctgctgcttctgctggcgcagacggccttttagtcgtaactccttattacagtaagccgagccaggagggattgctggcgcacttcggggcaatcgcagcagcaacagaggtgccaatttgcctctacgacattcctggtaggtcaggtattccaattgagtctgataccatgagacgcctgagtgaattacctacgattttggcggtcaaagacgccaaaggggacctggttgcagccacgtcattgatcaaagaaacgggacttgcctggtattcaggcgatgacccactaaaccttgtttggcttgctttgggcggatcaggttttatatccgtaattggacatgcagcccccacagcattaagggagttgtacacaagtttcgaggaaggcgacctggtccgtgcgagggagatcaacgccaaactatcaccgctggtagctgcccagggtcgcttgggtggagtcagcttggcaaaagctgctctgcgtctgcaaggcatcaacgtaggagatcctaggcttccaataatggctccaaatgagcaggaacttgaggctctgcgagaagacatgaaaaaagctggagttctataagaattctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaattgatatcggcgcgttaattaagcggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttgtacactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatctcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatca

SEQ ID NO: 27375 - DNA, 9769 bp, artificial
  pMON82053
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 27376 - DNA, 8504 bp, artificial
  pMON99053
gtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctg

SEQ ID NO: 27377 - protein, 527 aa, artificial
  consensus
  misc_feature (2)..(2): Xaa can be any naturally occurring amino acid
  misc_feature (6)..(6): Xaa can be any naturally occurring amino acid
  misc_feature (8)..(10): Xaa can be any naturally occurring amino acid
  misc_feature (13)..(95): Xaa can be any naturally occurring amino acid
  misc_feature (97)..(107): Xaa can be any naturally occurring amino acid
  misc_feature (109)..(110): Xaa can be any naturally occurring amino acid
  misc_feature (113)..(113): Xaa can be any naturally occurring amino acid
  misc_feature (116)..(116): Xaa can be any naturally occurring amino acid
  misc_feature (118)..(125): Xaa can be any naturally occurring amino acid
  misc_feature (129)..(130): Xaa can be any naturally occurring amino acid
  misc_feature (133)..(133): Xaa can be any naturally occurring amino acid
  misc_feature (135)..(171): Xaa can be any naturally occurring amino acid
  misc_feature (173)..(173): Xaa can be any naturally occurring amino acid
  misc_feature (175)..(176): Xaa can be any naturally occurring amino acid
  misc_feature (179)..(204): Xaa can be any naturally occurring amino acid
  misc_feature (206)..(328): Xaa can be any naturally occurring amino acid
  misc_feature (330)..(338): Xaa can be any naturally occurring amino acid
  misc_feature (340)..(368): Xaa can be any naturally occurring amino acid
  misc_feature (372)..(373): Xaa can be any naturally occurring amino acid
  misc_feature (375)..(375): Xaa can be any naturally occurring amino acid
  misc_feature (380)..(405): Xaa can be any naturally occurring amino acid
  misc_feature (408)..(413): Xaa can be any naturally occurring amino acid
  misc_feature (417)..(417): Xaa can be any naturally occurring amino acid
  misc_feature (419)..(429): Xaa can be any naturally occurring amino acid
  misc_feature (432)..(434): Xaa can be any naturally occurring amino acid
  misc_feature (438)..(438): Xaa can be any naturally occurring amino acid
  misc_feature (444)..(444): Xaa can be any naturally occurring amino acid
  misc_feature (449)..(459): Xaa can be any naturally occurring amino acid
  misc_feature (465)..(470): Xaa can be any naturally occurring amino acid
  misc_feature (473)..(491): Xaa can be any naturally occurring amino acid
  misc_feature (494)..(527): Xaa can be any naturally occurring amino acid
PXYYYXPXXXEEXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXVXXNLXTSXPXXXXXXXXDTYXXPPXPXXXXXXXXXXXXXXXXXXXXXXXXXXXXXXXXXXXXXPXDXXLGXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXXXXXXXXSXXXXXXXXXXXXXXXXXXXXXXXXXXXXXEEEXXDXCPICXXXXXXXXXXXXXXXXXXXXXXXXXXLEXXXXXXEYDXEXXXXXXXXXXXNPXXXTKCXHHFHLXCILEXXXXXXXXXXXWMERSXXXXXXCPXXXXXXXXXXXXXXXXXXXCDXXXXXXXXXXXXXXXXXXXXXXXXXXXXXXXXXX

SEQ ID NO: 27378 - protein, 248 aa, artificial
  consensus
  misc_feature (1)..(2): Xaa can be any naturally occurring amino acid
  misc_feature (4)..(4): Xaa can be any naturally occurring amino acid
  misc_feature (6)..(6): Xaa can be any naturally occurring amino acid
  misc_feature (10)..(10): Xaa can be any naturally occurring amino acid
  misc_feature (38)..(39): Xaa can be any naturally occurring amino acid
  misc_feature (45)..(45): Xaa can be any naturally occurring amino acid
  misc_feature (49)..(49): Xaa can be any naturally occurring amino acid
  misc_feature (63)..(64): Xaa can be any naturally occurring amino acid
  misc_feature (66)..(66): Xaa can be any naturally occurring amino acid
  misc_feature (70)..(70): Xaa can be any naturally occurring amino acid
  misc_feature (72)..(74): Xaa can be any naturally occurring amino acid
  misc_feature (78)..(78): Xaa can be any naturally occurring amino acid
  misc_feature (80)..(80): Xaa can be any naturally occurring amino acid
  misc_feature (83)..(83): Xaa can be any naturally occurring amino acid
  misc_feature (85)..(146): Xaa can be any naturally occurring amino acid
  misc_feature (148)..(158): Xaa can be any naturally occurring amino acid
  misc_feature (160)..(160): Xaa can be any naturally occurring amino acid
  misc_feature (166)..(167): Xaa can be any naturally occurring amino acid
  misc_feature (169)..(171): Xaa can be any naturally occurring amino acid
  misc_feature (176)..(176): Xaa can be any naturally occurring amino acid
  misc_feature (179)..(179): Xaa can be any naturally occurring amino acid
  misc_feature (190)..(190): Xaa can be any naturally occurring amino acid
  misc_feature (195)..(195): Xaa can be any naturally occurring amino acid
  misc_feature (201)..(201): Xaa can be any naturally occurring amino acid
  misc_feature (206)..(206): Xaa can be any naturally occurring amino acid
  misc_feature (208)..(221): Xaa can be any naturally occurring amino acid
  misc_feature (224)..(224): Xaa can be any naturally occurring amino acid
  misc_feature (226)..(248): Xaa can be any naturally occurring amino acid
XXWXVXLPAXEVPPELPEPALGINFARDGMQEKDWLSXXAVHSDXWLLXVAFYFGARFGFDKXXRXRLFXMXXXLPTXFXVVXGXXXXXXXXXXXXXXXXXXXXXXXXXXXXXXXXXXXXXXXXXXXXXXXXXXXXXXXXXXXXXXGXXXXXXXXXXXTXCGACGXXYXXXEFWIXCDXCEKWFHGKCVXITPAXAEHIKXYKCPXCXXXXXXXXXXXXXXKRXRXXXXXXXXXXXXXXXXXXXXXXX

SEQ ID NO: 27379 - protein, 275 aa, artificial
  consensus
  misc_feature (2)..(7): Xaa can be any naturally occurring amino acid
  misc_feature (9)..(10): Xaa can be any naturally occurring amino acid
  misc_feature (14)..(15): Xaa can be any naturally occurring amino acid
  misc_feature (17)..(39): Xaa can be any naturally occurring amino acid
  misc_feature (41)..(44): Xaa can be any naturally occurring amino acid
  misc_feature (46)..(46): Xaa can be any naturally occurring amino acid
  misc_feature (48)..(52): Xaa can be any naturally occurring amino acid
  misc_feature (55)..(57): Xaa can be any naturally occurring amino acid
  misc_feature (59)..(66): Xaa can be any naturally occurring amino acid
  misc_feature (68)..(68): Xaa can be any naturally occurring amino acid
  misc_feature (70)..(73): Xaa can be any naturally occurring amino acid
  misc_feature (75)..(76): Xaa can be any naturally occurring amino acid
  misc_feature (78)..(80): Xaa can be any naturally occurring amino acid
  misc_feature (82)..(82): Xaa can be any naturally occurring amino acid
  misc_feature (84)..(86): Xaa can be any naturally occurring amino acid
  misc_feature (97)..(98): Xaa can be any naturally occurring amino acid
  misc_feature (102)..(102): Xaa can be any naturally occurring amino acid
  misc_feature (107)..(109): Xaa can be any naturally occurring amino acid
  misc_feature (112)..(112): Xaa can be any naturally occurring amino acid
  misc_feature (121)..(121): Xaa can be any naturally occurring amino acid
  misc_feature (124)..(125): Xaa can be any naturally occurring amino acid
  misc_feature (127)..(127): Xaa can be any naturally occurring amino acid
  misc_feature (130)..(130): Xaa can be any naturally occurring amino acid
  misc_feature (132)..(132): Xaa can be any naturally occurring amino acid
  misc_feature (135)..(136): Xaa can be any naturally occurring amino acid
  misc_feature (139)..(140): Xaa can be any naturally occurring amino acid
  misc_feature (143)..(145): Xaa can be any naturally occurring amino acid
  misc_feature (148)..(148): Xaa can be any naturally occurring amino acid
  misc_feature (154)..(158): Xaa can be any naturally occurring amino acid
  misc_feature (163)..(163): Xaa can be any naturally occurring amino acid
  misc_feature (169)..(169): Xaa can be any naturally occurring amino acid
  misc_feature (171)..(171): Xaa can be any naturally occurring amino acid
  misc_feature (173)..(173): Xaa can be any naturally occurring amino acid
  misc_feature (177)..(181): Xaa can be any naturally occurring amino acid
  misc_feature (183)..(183): Xaa can be any naturally occurring amino acid
  misc_feature (185)..(198): Xaa can be any naturally occurring amino acid
  misc_feature (200)..(200): Xaa can be any naturally occurring amino acid
  misc_feature (202)..(203): Xaa can be any naturally occurring amino acid
  misc_feature (205)..(206): Xaa can be any naturally occurring amino acid
  misc_feature (208)..(208): Xaa can be any naturally occurring amino acid
  misc_feature (210)..(210): Xaa can be any naturally occurring amino acid
  misc_feature (212)..(218): Xaa can be any naturally occurring amino acid
  misc_feature (220)..(222): Xaa can be any naturally occurring amino acid
  misc_feature (226)..(226): Xaa can be any naturally occurring amino acid
  misc_feature (233)..(233): Xaa can be any naturally occurring amino acid
  misc_feature (239)..(239): Xaa can be any naturally occurring amino acid
  misc_feature (243)..(245): Xaa can be any naturally occurring amino acid
  misc_feature (247)..(275): Xaa can be any naturally occurring amino acid
AXXXXXXWXXKLPXXYXXXXXXXXXXXXXXXXXXXXXXXKXXXXAXLXXXXXFDXXXKXXXXXXXXWXDXXXXGXXCXXXSXKXXXITGIDDRRYWXXIPTXESRFXXXAYXQQIWWFEVXGEXXFXFPXGXYSXXFRXXLGXXXKRXGRRVCXXXXXHGWDXKPVRFXLXTXDGQXXXXXCXLXXXXXXXXXXXXXXGXWXXYXXGXFXVXXXXXXXTXXXFSMXQIDCTHXKGGLCXDSVXXXPXXXXXXXXXXXXXXXXXXXXXXXXXXXXX

SEQ ID NO: 27380 - protein, 556 aa, artificial
  consensus
  misc_feature (1)..(79): Xaa can be any naturally occurring amino acid
  misc_feature (84)..(94): Xaa can be any naturally occurring amino acid
  misc_feature (96)..(99): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(105): Xaa can be any naturally occurring amino acid
  misc_feature (108)..(109): Xaa can be any naturally occurring amino acid
  misc_feature (111)..(111): Xaa can be any naturally occurring amino acid
  misc_feature (114)..(114): Xaa can be any naturally occurring amino acid
  misc_feature (119)..(119): Xaa can be any naturally occurring amino acid
  misc_feature (122)..(132): Xaa can be any naturally occurring amino acid
  misc_feature (139)..(143): Xaa can be any naturally occurring amino acid
  misc_feature (145)..(146): Xaa can be any naturally occurring amino acid
  misc_feature (152)..(152): Xaa can be any naturally occurring amino acid
  misc_feature (158)..(159): Xaa can be any naturally occurring amino acid
  misc_feature (161)..(162): Xaa can be any naturally occurring amino acid
  misc_feature (166)..(169): Xaa can be any naturally occurring amino acid
  misc_feature (171)..(173): Xaa can be any naturally occurring amino acid
  misc_feature (176)..(176): Xaa can be any naturally occurring amino acid
  misc_feature (178)..(180): Xaa can be any naturally occurring amino acid
  misc_feature (183)..(183): Xaa can be any naturally occurring amino acid
  misc_feature (186)..(190): Xaa can be any naturally occurring amino acid
  misc_feature (196)..(204): Xaa can be any naturally occurring amino acid
  misc_feature (206)..(231): Xaa can be any naturally occurring amino acid
  misc_feature (234)..(237): Xaa can be any naturally occurring amino acid
  misc_feature (239)..(262): Xaa can be any naturally occurring amino acid
  misc_feature (265)..(287): Xaa can be any naturally occurring amino acid
  misc_feature (289)..(304): Xaa can be any naturally occurring amino acid
  misc_feature (306)..(306): Xaa can be any naturally occurring amino acid
  misc_feature (308)..(310): Xaa can be any naturally occurring amino acid
  misc_feature (312)..(360): Xaa can be any naturally occurring amino acid
  misc_feature (362)..(404): Xaa can be any naturally occurring amino acid
  misc_feature (406)..(446): Xaa can be any naturally occurring amino acid
  misc_feature (448)..(556): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXCSICXXXXXXXXXXXRXXXXLXCXHXFHXXCXIGXSAFNXKGXXXXXXXXXXXMQCPNCXXXXXRXXEKGQWXLYANGXXRXXPEFXXXXWXXXEDXYXXXSYXEMXXXXXWCPFGXXXXXXXXXEXXXXXXXXXXXXXXXXXXXXXXXXXXYHXXXXGXXXXXXXXXXXXXXXXXXXXXXXXGPXXXXXXXXXXXXXXXXXXXXXXXWXXXXXXXXXXXXXXXXPXVXXXYXXXXXXXXXXXXXXXXXXXXXXXXXXXXXXXXXXXXXXXXXXXXXXXXXRXXXXXXXXXXXXXXXXXXXXXXXXXXXXXXXXXXXXXXXXXXXGXXXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27381 - protein, 1382 aa, artificial
  consensus
  misc_feature (1)..(724): Xaa can be any naturally occurring amino acid
  misc_feature (726)..(726): Xaa can be any naturally occurring amino acid
  misc_feature (728)..(763): Xaa can be any naturally occurring amino acid
  misc_feature (765)..(765): Xaa can be any naturally occurring amino acid
  misc_feature (767)..(774): Xaa can be any naturally occurring amino acid
  misc_feature (776)..(779): Xaa can be any naturally occurring amino acid
  misc_feature (781)..(784): Xaa can be any naturally occurring amino acid
  misc_feature (786)..(786): Xaa can be any naturally occurring amino acid
  misc_feature (788)..(789): Xaa can be any naturally occurring amino acid
  misc_feature (792)..(824): Xaa can be any naturally occurring amino acid
  misc_feature (826)..(827): Xaa can be any naturally occurring amino acid
  misc_feature (829)..(848): Xaa can be any naturally occurring amino acid
  misc_feature (850)..(867): Xaa can be any naturally occurring amino acid
  misc_feature (869)..(871): Xaa can be any naturally occurring amino acid
  misc_feature (873)..(874): Xaa can be any naturally occurring amino acid
  misc_feature (876)..(954): Xaa can be any naturally occurring amino acid
  misc_feature (956)..(980): Xaa can be any naturally occurring amino acid
  misc_feature (982)..(1004): Xaa can be any naturally occurring amino acid
  misc_feature (1006)..(1114): Xaa can be any naturally occurring amino acid
  misc_feature (1116)..(1133): Xaa can be any naturally occurring amino acid
  misc_feature (1136)..(1139): Xaa can be any naturally occurring amino acid
  misc_feature (1142)..(1142): Xaa can be any naturally occurring amino acid
  misc_feature (1145)..(1151): Xaa can be any naturally occurring amino acid
  misc_feature (1153)..(1154): Xaa can be any naturally occurring amino acid
  misc_feature (1160)..(1160): Xaa can be any naturally occurring amino acid
  misc_feature (1163)..(1163): Xaa can be any naturally occurring amino acid
  misc_feature (1165)..(1170): Xaa can be any naturally occurring amino acid
  misc_feature (1173)..(1175): Xaa can be any naturally occurring amino acid
  misc_feature (1177)..(1179): Xaa can be any naturally occurring amino acid
  misc_feature (1181)..(1195): Xaa can be any naturally occurring amino acid
  misc_feature (1198)..(1217): Xaa can be any naturally occurring amino acid
  misc_feature (1221)..(1225): Xaa can be any naturally occurring amino acid
  misc_feature (1227)..(1232): Xaa can be any naturally occurring amino acid
  misc_feature (1235)..(1237): Xaa can be any naturally occurring amino acid
  misc_feature (1239)..(1248): Xaa can be any naturally occurring amino acid
  misc_feature (1250)..(1267): Xaa can be any naturally occurring amino acid
  misc_feature (1269)..(1382): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXAXXXXXXXXXXXXXXXXXXXXXXXXXXXXXXXXXXXXDXRXXXXXXXXAXXXXDXXXXKXHXXLGXXXXXXXXXXXXXXXXXXXXXXXXXXXXXXXXXLXXAXXXXXXXXXXXXXXXXXXXXLXXXXXXXXXXXXXXXXXXIXXXLXXAXXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXXXXXXXXXXXXXXRXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXXXXXXXXXXXXPDXXXXLCXKIXXXXXXXPXXITPSGXTYXRXXXXXXHLXXXGXXXFXXXXXXXXXXXXXXXDPXXXXXXXXXXXXXXXXXXXXVTRXXXXXLXXXXXXPNXXXKXXXXXXXXXXEXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27382 - protein, 1156 aa, artificial
  consensus
  misc_feature (1)..(1): Xaa can be any naturally occurring amino acid
  misc_feature (3)..(4): Xaa can be any naturally occurring amino acid
  misc_feature (6)..(6): Xaa can be any naturally occurring amino acid
  misc_feature (9)..(9): Xaa can be any naturally occurring amino acid
  misc_feature (11)..(12): Xaa can be any naturally occurring amino acid
  misc_feature (14)..(15): Xaa can be any naturally occurring amino acid
  misc_feature (17)..(23): Xaa can be any naturally occurring amino acid
  misc_feature (25)..(27): Xaa can be any naturally occurring amino acid
  misc_feature (29)..(30): Xaa can be any naturally occurring amino acid
  misc_feature (32)..(83): Xaa can be any naturally occurring amino acid
  misc_feature (85)..(213): Xaa can be any naturally occurring amino acid
  misc_feature (215)..(216): Xaa can be any naturally occurring amino acid
  misc_feature (218)..(223): Xaa can be any naturally occurring amino acid
  misc_feature (226)..(229): Xaa can be any naturally occurring amino acid
  misc_feature (231)..(274): Xaa can be any naturally occurring amino acid
  misc_feature (276)..(286): Xaa can be any naturally occurring amino acid
  misc_feature (290)..(292): Xaa can be any naturally occurring amino acid
  misc_feature (294)..(296): Xaa can be any naturally occurring amino acid
  misc_feature (298)..(300): Xaa can be any naturally occurring amino acid
  misc_feature (304)..(304): Xaa can be any naturally occurring amino acid
  misc_feature (307)..(308): Xaa can be any naturally occurring amino acid
  misc_feature (311)..(312): Xaa can be any naturally occurring amino acid
  misc_feature (314)..(315): Xaa can be any naturally occurring amino acid
  misc_feature (317)..(318): Xaa can be any naturally occurring amino acid
  misc_feature (320)..(341): Xaa can be any naturally occurring amino acid
  misc_feature (343)..(345): Xaa can be any naturally occurring amino acid
  misc_feature (348)..(349): Xaa can be any naturally occurring amino acid
  misc_feature (351)..(352): Xaa can be any naturally occurring amino acid
  misc_feature (356)..(1156): Xaa can be any naturally occurring amino acid
XCXXCXFPXCXXCXXYXXXXXXXGXXXCXXCXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXRXXXXXXWKXXXXKXXXXXXXXXXXXXXXXXXXXXXXXXXXXXXXXXXXXXXXXXXXXDXXXXXXXXXXXPLSXXXPXXXSXXXPYRXVIXXRLXXLXXFXXYXXXXXXXXXXXXXXXXXXXXXXRXXXPVXXAXXLWLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27383 - protein, 326 aa, artificial
  consensus
  misc_feature (21)..(34): Xaa can be any naturally occurring amino acid
  misc_feature (37)..(37): Xaa can be any naturally occurring amino acid
  misc_feature (42)..(42): Xaa can be any naturally occurring amino acid
  misc_feature (47)..(47): Xaa can be any naturally occurring amino acid
  misc_feature (49)..(49): Xaa can be any naturally occurring amino acid
  misc_feature (51)..(51): Xaa can be any naturally occurring amino acid
  misc_feature (53)..(68): Xaa can be any naturally occurring amino acid
  misc_feature (70)..(87): Xaa can be any naturally occurring amino acid
  misc_feature (89)..(89): Xaa can be any naturally occurring amino acid
  misc_feature (91)..(91): Xaa can be any naturally occurring amino acid
  misc_feature (97)..(97): Xaa can be any naturally occurring amino acid
  misc_feature (101)..(101): Xaa can be any naturally occurring amino acid
  misc_feature (103)..(107): Xaa can be any naturally occurring amino acid
  misc_feature (109)..(113): Xaa can be any naturally occurring amino acid
  misc_feature (115)..(116): Xaa can be any naturally occurring amino acid
  misc_feature (118)..(118): Xaa can be any naturally occurring amino acid
  misc_feature (121)..(121): Xaa can be any naturally occurring amino acid
  misc_feature (129)..(130): Xaa can be any naturally occurring amino acid
  misc_feature (133)..(133): Xaa can be any naturally occurring amino acid
  misc_feature (135)..(148): Xaa can be any naturally occurring amino acid
  misc_feature (150)..(209): Xaa can be any naturally occurring amino acid
  misc_feature (211)..(231): Xaa can be any naturally occurring amino acid
  misc_feature (233)..(234): Xaa can be any naturally occurring amino acid
  misc_feature (238)..(239): Xaa can be any naturally occurring amino acid
  misc_feature (241)..(243): Xaa can be any naturally occurring amino acid
  misc_feature (245)..(246): Xaa can be any naturally occurring amino acid
  misc_feature (252)..(252): Xaa can be any naturally occurring amino acid
  misc_feature (258)..(258): Xaa can be any naturally occurring amino acid
  misc_feature (260)..(262): Xaa can be any naturally occurring amino acid
  misc_feature (265)..(268): Xaa can be any naturally occurring amino acid
  misc_feature (271)..(272): Xaa can be any naturally occurring amino acid
  misc_feature (274)..(274): Xaa can be any naturally occurring amino acid
  misc_feature (278)..(280): Xaa can be any naturally occurring amino acid
  misc_feature (282)..(294): Xaa can be any naturally occurring amino acid
  misc_feature (299)..(299): Xaa can be any naturally occurring amino acid
  misc_feature (306)..(312): Xaa can be any naturally occurring amino acid
  misc_feature (316)..(321): Xaa can be any naturally occurring amino acid
  misc_feature (324)..(326): Xaa can be any naturally occurring amino acid
PICWESFNIVENVPYVLWCGXXXXXXXXXXXXXXHTXCKNCXLGLQXAXVXKXXXXXXXXXXXXXXXXPXXXXXXXXXXXXXXXXXXPXFXSCPWCXLLSXRXXXXXGXXXXXLXXPXKNXFLLWMVEXXNGXRXXXXXXXXXXXXXXDXXXXXXXXXXXXXXXXXXXXXXXXXXXXXXXXXXXXXXXXXXXXXXXXXXXXXXXXXXXXSXXXXXXXXXXXXXXXXXXXXXSXXKSLXXFXXXTXXKFPLVXIFLLIXLXXXIPXXXXILXXYXLVTXXXAXXXXXXXXXXXXXPSFLXLYFAYPXXXXXXXLVRXXXXXXEIXXX

SEQ ID NO: 27384 - protein, 313 aa, artificial
  consensus
  misc_feature (1)..(11): Xaa can be any naturally occurring amino acid
  misc_feature (13)..(13): Xaa can be any naturally occurring amino acid
  misc_feature (15)..(29): Xaa can be any naturally occurring amino acid
  misc_feature (32)..(33): Xaa can be any naturally occurring amino acid
  misc_feature (35)..(35): Xaa can be any naturally occurring amino acid
  misc_feature (39)..(45): Xaa can be any naturally occurring amino acid
  misc_feature (49)..(50): Xaa can be any naturally occurring amino acid
  misc_feature (52)..(53): Xaa can be any naturally occurring amino acid
  misc_feature (56)..(63): Xaa can be any naturally occurring amino acid
  misc_feature (66)..(67): Xaa can be any naturally occurring amino acid
  misc_feature (70)..(89): Xaa can be any naturally occurring amino acid
  misc_feature (91)..(91): Xaa can be any naturally occurring amino acid
  misc_feature (93)..(96): Xaa can be any naturally occurring amino acid
  misc_feature (100)..(106): Xaa can be any naturally occurring amino acid
  misc_feature (108)..(109): Xaa can be any naturally occurring amino acid
  misc_feature (112)..(112): Xaa can be any naturally occurring amino acid
  misc_feature (115)..(117): Xaa can be any naturally occurring amino acid
  misc_feature (123)..(125): Xaa can be any naturally occurring amino acid
  misc_feature (127)..(127): Xaa can be any naturally occurring amino acid
  misc_feature (129)..(134): Xaa can be any naturally occurring amino acid
  misc_feature (136)..(137): Xaa can be any naturally occurring amino acid
  misc_feature (140)..(140): Xaa can be any naturally occurring amino acid
  misc_feature (145)..(148): Xaa can be any naturally occurring amino acid
  misc_feature (159)..(169): Xaa can be any naturally occurring amino acid
  misc_feature (175)..(175): Xaa can be any naturally occurring amino acid
  misc_feature (177)..(184): Xaa can be any naturally occurring amino acid
  misc_feature (186)..(289): Xaa can be any naturally occurring amino acid
  misc_feature (291)..(291): Xaa can be any naturally occurring amino acid
  misc_feature (294)..(301): Xaa can be any naturally occurring amino acid
  misc_feature (303)..(303): Xaa can be any naturally occurring amino acid
  misc_feature (305)..(313): Xaa can be any naturally occurring amino acid
XXXXXXXXXXXDXLXXXXXXXXXXXXXXXLPXXDXARAXXXXXXXCVCXXWXXVAXXXXXXXXAFXXPWXXXXXXXXXXXXXXXXXXXXGXPXXXXFWRXXXXXXXLXXFAXSHXXXRGDTVXXXAXKXXXXXXYXXQVXDIKRXXXXNNMMSDHGIYXXXXXXXXXXXSNPEIXLXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXPRXXXXXXXXDXRXXXXXXXXX

SEQ ID NO: 27385 - protein, 386 aa, artificial
  consensus
  misc_feature (1)..(14): Xaa can be any naturally occurring amino acid
  misc_feature (16)..(17): Xaa can be any naturally occurring amino acid
  misc_feature (19)..(28): Xaa can be any naturally occurring amino acid
  misc_feature (31)..(33): Xaa can be any naturally occurring amino acid
  misc_feature (35)..(60): Xaa can be any naturally occurring amino acid
  misc_feature (62)..(62): Xaa can be any naturally occurring amino acid
  misc_feature (64)..(80): Xaa can be any naturally occurring amino acid
  misc_feature (82)..(96): Xaa can be any naturally occurring amino acid
  misc_feature (98)..(201): Xaa can be any naturally occurring amino acid
  misc_feature (203)..(208): Xaa can be any naturally occurring amino acid
  misc_feature (210)..(211): Xaa can be any naturally occurring amino acid
  misc_feature (213)..(214): Xaa can be any naturally occurring amino acid
  misc_feature (216)..(218): Xaa can be any naturally occurring amino acid
  misc_feature (220)..(221): Xaa can be any naturally occurring amino acid
  misc_feature (223)..(243): Xaa can be any naturally occurring amino acid
  misc_feature (245)..(270): Xaa can be any naturally occurring amino acid
  misc_feature (272)..(277): Xaa can be any naturally occurring amino acid
  misc_feature (279)..(331): Xaa can be any naturally occurring amino acid
  misc_feature (334)..(334): Xaa can be any naturally occurring amino acid
  misc_feature (336)..(343): Xaa can be any naturally occurring amino acid
  misc_feature (345)..(346): Xaa can be any naturally occurring amino acid
  misc_feature (350)..(352): Xaa can be any naturally occurring amino acid
  misc_feature (354)..(355): Xaa can be any naturally occurring amino acid
  misc_feature (357)..(368): Xaa can be any naturally occurring amino acid
  misc_feature (371)..(371): Xaa can be any naturally occurring amino acid
  misc_feature (374)..(376): Xaa can be any naturally occurring amino acid
  misc_feature (378)..(386): Xaa can be any naturally occurring amino acid
XXXXXXXXXXXXXXLXXAXXXXXXXXXXDLXXXLXXXXXXXXXXXXXXXXXXXXXXXXXXGXVXXXXXXXXXXXXXXXXXVXXXXXXXXXXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXEXXLXXGXXXTXXGXXXXXXXXXXXXXXXXXXXXXLXXXXXXXXXXXXXXXXXXXXXXXXXXGXXXXXXLXXXXXXXXXXXXXXXXXXXXXXXXXXXXXXXXXXXXXXXXXXXXXXXXXXXXXCVXCXXXXXXXXFXXCGHXXXCXXCXXXXXXXXXXXXCPXCRXXXIXXXXXXXXX

SEQ ID NO: 27386 - protein, 1102 aa, artificial
  consensus
  misc_feature (1)..(68): Xaa can be any naturally occurring amino acid
  misc_feature (70)..(75): Xaa can be any naturally occurring amino acid
  misc_feature (77)..(78): Xaa can be any naturally occurring amino acid
  misc_feature (80)..(85): Xaa can be any naturally occurring amino acid
  misc_feature (87)..(97): Xaa can be any naturally occurring amino acid
  misc_feature (99)..(103): Xaa can be any naturally occurring amino acid
  misc_feature (105)..(105): Xaa can be any naturally occurring amino acid
  misc_feature (109)..(110): Xaa can be any naturally occurring amino acid
  misc_feature (115)..(116): Xaa can be any naturally occurring amino acid
  misc_feature (118)..(149): Xaa can be any naturally occurring amino acid
  misc_feature (152)..(153): Xaa can be any naturally occurring amino acid
  misc_feature (155)..(160): Xaa can be any naturally occurring amino acid
  misc_feature (162)..(175): Xaa can be any naturally occurring amino acid
  misc_feature (177)..(178): Xaa can be any naturally occurring amino acid
  misc_feature (180)..(185): Xaa can be any naturally occurring amino acid
  misc_feature (187)..(189): Xaa can be any naturally occurring amino acid
  misc_feature (191)..(201): Xaa can be any naturally occurring amino acid
  misc_feature (203)..(203): Xaa can be any naturally occurring amino acid
  misc_feature (208)..(211): Xaa can be any naturally occurring amino acid
  misc_feature (213)..(227): Xaa can be any naturally occurring amino acid
  misc_feature (229)..(232): Xaa can be any naturally occurring amino acid
  misc_feature (234)..(236): Xaa can be any naturally occurring amino acid
  misc_feature (238)..(256): Xaa can be any naturally occurring amino acid
  misc_feature (258)..(263): Xaa can be any naturally occurring amino acid
  misc_feature (265)..(266): Xaa can be any naturally occurring amino acid
  misc_feature (269)..(269): Xaa can be any naturally occurring amino acid
  misc_feature (272)..(272): Xaa can be any naturally occurring amino acid
  misc_feature (275)..(275): Xaa can be any naturally occurring amino acid
  misc_feature (277)..(277): Xaa can be any naturally occurring amino acid
  misc_feature (279)..(279): Xaa can be any naturally occurring amino acid
  misc_feature (283)..(286): Xaa can be any naturally occurring amino acid
  misc_feature (288)..(289): Xaa can be any naturally occurring amino acid
  misc_feature (291)..(305): Xaa can be any naturally occurring amino acid
  misc_feature (307)..(309): Xaa can be any naturally occurring amino acid
  misc_feature (312)..(314): Xaa can be any naturally occurring amino acid
  misc_feature (316)..(317): Xaa can be any naturally occurring amino acid
  misc_feature (319)..(320): Xaa can be any naturally occurring amino acid
  misc_feature (323)..(338): Xaa can be any naturally occurring amino acid
  misc_feature (340)..(341): Xaa can be any naturally occurring amino acid
  misc_feature (345)..(346): Xaa can be any naturally occurring amino acid
  misc_feature (348)..(349): Xaa can be any naturally occurring amino acid
  misc_feature (351)..(352): Xaa can be any naturally occurring amino acid
  misc_feature (354)..(354): Xaa can be any naturally occurring amino acid
  misc_feature (356)..(357): Xaa can be any naturally occurring amino acid
  misc_feature (361)..(363): Xaa can be any naturally occurring amino acid
  misc_feature (365)..(365): Xaa can be any naturally occurring amino acid
  misc_feature (368)..(374): Xaa can be any naturally occurring amino acid
  misc_feature (376)..(393): Xaa can be any naturally occurring amino acid
  misc_feature (396)..(398): Xaa can be any naturally occurring amino acid
  misc_feature (400)..(401): Xaa can be any naturally occurring amino acid
  misc_feature (404)..(404): Xaa can be any naturally occurring amino acid
  misc_feature (406)..(408): Xaa can be any naturally occurring amino acid
  misc_feature (410)..(412): Xaa can be any naturally occurring amino acid
  misc_feature (414)..(422): Xaa can be any naturally occurring amino acid
  misc_feature (425)..(438): Xaa can be any naturally occurring amino acid
  misc_feature (440)..(516): Xaa can be any naturally occurring amino acid
  misc_feature (518)..(527): Xaa can be any naturally occurring amino acid
  misc_feature (529)..(539): Xaa can be any naturally occurring amino acid
  misc_feature (541)..(543): Xaa can be any naturally occurring amino acid
  misc_feature (545)..(552): Xaa can be any naturally occurring amino acid
  misc_feature (554)..(572): Xaa can be any naturally occurring amino acid
  misc_feature (574)..(579): Xaa can be any naturally occurring amino acid
  misc_feature (581)..(675): Xaa can be any naturally occurring amino acid
  misc_feature (677)..(679): Xaa can be any naturally occurring amino acid
  misc_feature (681)..(682): Xaa can be any naturally occurring amino acid
  misc_feature (684)..(693): Xaa can be any naturally occurring amino acid
  misc_feature (696)..(783): Xaa can be any naturally occurring amino acid
  misc_feature (785)..(788): Xaa can be any naturally occurring amino acid
  misc_feature (790)..(814): Xaa can be any naturally occurring amino acid
  misc_feature (816)..(1040): Xaa can be any naturally occurring amino acid
  misc_feature (1043)..(1043): Xaa can be any naturally occurring amino acid
  misc_feature (1046)..(1102): Xaa can be any naturally occurring amino acid
XXXXXXXXXXXXXXXXXXXXXXXXXXXXXXXXXXXXXXXXXXXXXXXXXXXXXXXXXXXXXXXXXXXXWXXXXXXGXXKXXXXXXGXXXXXXXXXXXFXXXXXMXLYTXXYNMCXXKXXXXXXXXXXXXXXXXXXXXXXXXXXXXXXXXLYXXYXXXXXXYXXXXXXXXXXXXXXEXXLXXXXXXWXXXHXXXXXXXXXXXFXYLDRXXXXRXXXXXXXXXXXXXXXLXXXXLXXXRXXXXXXXXXXXXXXXXXXXLXXXXXXIXXERXGEXIDXRXLXKNVXXXXVXXGXXXXXXXXXXXXXXXYXXXFEXXXLXXTXXYYXXXXXXXXXXXXXXXXYXXKAEXXLXXEXXRXVXXYLHXXXEXKLXXXXXXXLXXXXXXXXXXXXXXXXXXLLXXXKXXDLXRXXXLXXXIXXXXXXXXXGLXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXHXXXXXXXXXXFXXXXXXXXXXXFXXXLXXXXXXXXNXXXXXXXXXXXXXXXXXXXEXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXKXXFXXXXXXXXXXRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXWXXXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVRXMKXXXXXXXXXXXXXXXXXXXXXXXXXXXXXXXXXXXXXXXXXXXXXXXXXXXXXXXXX

SEQ ID NO: 27387 - protein, 1059 aa, artificial
  consensus
  misc_feature (1)..(499): Xaa can be any naturally occurring amino acid
  misc_feature (501)..(574): Xaa can be any naturally occurring amino acid
  misc_feature (576)..(584): Xaa can be any naturally occurring amino acid
  misc_feature (586)..(588): Xaa can be any naturally occurring amino acid
  misc_feature (590)..(592): Xaa can be any naturally occurring amino acid
  misc_feature (594)..(595): Xaa can be any naturally occurring amino acid
  misc_feature (599)..(600): Xaa can be any naturally occurring amino acid
  misc_feature (610)..(610): Xaa can be any naturally occurring amino acid
  misc_feature (612)..(612): Xaa can be any naturally occurring amino acid
  misc_feature (616)..(733): Xaa can be any naturally occurring amino acid
  misc_feature (735)..(736): Xaa can be any naturally occurring amino acid
  misc_feature (738)..(738): Xaa can be any naturally occurring amino acid
  misc_feature (742)..(770): Xaa can be any naturally occurring amino acid
  misc_feature (772)..(774): Xaa can be any naturally occurring amino acid
  misc_feature (779)..(779): Xaa can be any naturally occurring amino acid
  misc_feature (781)..(782): Xaa can be any naturally occurring amino acid
  misc_feature (785)..(786): Xaa can be any naturally occurring amino acid
  misc_feature (790)..(790): Xaa can be any naturally occurring amino acid
  misc_feature (792)..(793): Xaa can be any naturally occurring amino acid
  misc_feature (795)..(795): Xaa can be any naturally occurring amino acid
  misc_feature (797)..(809): Xaa can be any naturally occurring amino acid
  misc_feature (811)..(824): Xaa can be any naturally occurring amino acid
  misc_feature (826)..(831): Xaa can be any naturally occurring amino acid
  misc_feature (833)..(835): Xaa can be any naturally occurring amino acid
  misc_feature (839)..(839): Xaa can be any naturally occurring amino acid
  misc_feature (841)..(841): Xaa can be any naturally occurring amino acid
  misc_feature (843)..(875): Xaa can be any naturally occurring amino acid
  misc_feature (878)..(879): Xaa can be any naturally occurring amino acid
  misc_feature (881)..(881): Xaa can be any naturally occurring amino acid
  misc_feature (883)..(904): Xaa can be any naturally occurring amino acid
  misc_feature (911)..(912): Xaa can be any naturally occurring amino acid
  misc_feature (914)..(914): Xaa can be any naturally occurring amino acid
  misc_feature (916)..(933): Xaa can be any naturally occurring amino acid
  misc_feature (936)..(948): Xaa can be any naturally occurring amino acid
  misc_feature (951)..(951): Xaa can be any naturally occurring amino acid
  misc_feature (953)..(961): Xaa can be any naturally occurring amino acid
  misc_feature (963)..(964): Xaa can be any naturally occurring amino acid
  misc_feature (967)..(968): Xaa can be any naturally occurring amino acid
  misc_feature (971)..(987): Xaa can be any naturally occurring amino acid
  misc_feature (989)..(996): Xaa can be any naturally occurring amino acid
  misc_feature (999)..(999): Xaa can be any naturally occurring amino acid
  misc_feature (1002)..(1003): Xaa can be any naturally occurring amino acid
  misc_feature (1006)..(1059): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXXXXXXXXXXXXXXXXXXXXXXXXXXXXXXXXXXXXXXXXXXXXXXXXXXXXXXXXXXXXXXXXXXXXXXXXXLXXXXXXXXXLXXXFXXXAXXKFVXXSIFEMRYLLXIXWKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXWXPQIXXXXXXXXXXXXXXXXXXXXXXXXXXXXXLXXXYILGXTXXRLXXPLYXFXXPXNXXXXXXXXXXXXXPXXXXXXXXXXXXXXQXXXXXXQXXXGSRXFXPXXXXXXXXXXXXXXXXXXXXXXXXXXXXXXXXXLPXXYXYXXXXXXXXXXXXXXXXXXXXXXDCVICMXXIXLXXXXXXXXXXXXXXXXXXMVXXXXXXXXXXXXXPCXHXXXXXXXXXHXXCLXXWMXXXXXXXXXXXXXXXXXIXXXXXXXXCPXCRXXLPXXXXXXXXXXXXXXXXXXXXXXXXXXXXXXXXXXXXXXXXXXXXXXXXXXXXXX

SEQ ID NO: 27388 - protein, 370 aa, artificial
  consensus
  misc_feature (1)..(25): Xaa can be any naturally occurring amino acid
  misc_feature (28)..(30): Xaa can be any naturally occurring amino acid
  misc_feature (34)..(35): Xaa can be any naturally occurring amino acid
  misc_feature (39)..(45): Xaa can be any naturally occurring amino acid
  misc_feature (47)..(51): Xaa can be any naturally occurring amino acid
  misc_feature (59)..(59): Xaa can be any naturally occurring amino acid
  misc_feature (63)..(63): Xaa can be any naturally occurring amino acid
  misc_feature (68)..(69): Xaa can be any naturally occurring amino acid
  misc_feature (72)..(93): Xaa can be any naturally occurring amino acid
  misc_feature (95)..(96): Xaa can be any naturally occurring amino acid
  misc_feature (98)..(99): Xaa can be any naturally occurring amino acid
  misc_feature (102)..(102): Xaa can be any naturally occurring amino acid
  misc_feature (105)..(108): Xaa can be any naturally occurring amino acid
  misc_feature (111)..(112): Xaa can be any naturally occurring amino acid
  misc_feature (114)..(131): Xaa can be any naturally occurring amino acid
  misc_feature (134)..(134): Xaa can be any naturally occurring amino acid
  misc_feature (137)..(137): Xaa can be any naturally occurring amino acid
  misc_feature (140)..(161): Xaa can be any naturally occurring amino acid
  misc_feature (169)..(170): Xaa can be any naturally occurring amino acid
  misc_feature (172)..(203): Xaa can be any naturally occurring amino acid
  misc_feature (208)..(209): Xaa can be any naturally occurring amino acid
  misc_feature (212)..(214): Xaa can be any naturally occurring amino acid
  misc_feature (216)..(218): Xaa can be any naturally occurring amino acid
  misc_feature (220)..(222): Xaa can be any naturally occurring amino acid
  misc_feature (225)..(234): Xaa can be any naturally occurring amino acid
  misc_feature (237)..(237): Xaa can be any naturally occurring amino acid
  misc_feature (239)..(239): Xaa can be any naturally occurring amino acid
  misc_feature (243)..(243): Xaa can be any naturally occurring amino acid
  misc_feature (249)..(249): Xaa can be any naturally occurring amino acid
  misc_feature (251)..(253): Xaa can be any naturally occurring amino acid
  misc_feature (255)..(255): Xaa can be any naturally occurring amino acid
  misc_feature (259)..(259): Xaa can be any naturally occurring amino acid
  misc_feature (261)..(263): Xaa can be any naturally occurring amino acid
  misc_feature (266)..(266): Xaa can be any naturally occurring amino acid
  misc_feature (268)..(269): Xaa can be any naturally occurring amino acid
  misc_feature (271)..(273): Xaa can be any naturally occurring amino acid
  misc_feature (275)..(277): Xaa can be any naturally occurring amino acid
  misc_feature (279)..(279): Xaa can be any naturally occurring amino acid
  misc_feature (285)..(286): Xaa can be any naturally occurring amino acid
  misc_feature (288)..(289): Xaa can be any naturally occurring amino acid
  misc_feature (292)..(292): Xaa can be any naturally occurring amino acid
  misc_feature (294)..(297): Xaa can be any naturally occurring amino acid
  misc_feature (300)..(305): Xaa can be any naturally occurring amino acid
  misc_feature (307)..(307): Xaa can be any naturally occurring amino acid
  misc_feature (309)..(328): Xaa can be any naturally occurring amino acid
  misc_feature (331)..(332): Xaa can be any naturally occurring amino acid
  misc_feature (336)..(337): Xaa can be any naturally occurring amino acid
  misc_feature (339)..(339): Xaa can be any naturally occurring amino acid
  misc_feature (345)..(348): Xaa can be any naturally occurring amino acid
  misc_feature (350)..(354): Xaa can be any naturally occurring amino acid
  misc_feature (356)..(370): Xaa can be any naturally occurring amino acid
XXXXXXXXXXXXXXXXXXXXXXXXXDGXXXQMRXXYSPXXXXXXXAXXXXXLVQWTDCXLAGXLGLLXXLIXXXXXXXXXXXXXXXXXXXXXXYXXYXXDGXTTXXXXERXXSXXXXXXXXXXXXXXXXXXIRXFYXVIXXXXXXXXXXXXXXXXXXXXXXFPSLLQLXXGXXXXXXXXXXXXXXXXXXXXXXXXXXXXXXXXITDLXXRKXXXQXXXCXXXYRXXXXXXXXXXSEXDXEREXECGICXEXXXKXVLPXCXXXHSXCXXCXXXWXXXSXSCPFCXXRXXLKXVXXXXLWXXXXXXDXVXXXXXXXXXXXXXXXXXXXXENXXRLFXXIXKLPLVXXXXVXXXXXYXXXXXXXXXXXXXXX

SEQ ID NO: 27389 - protein, 669 aa, artificial
  consensus
  misc_feature (1)..(81): Xaa can be any naturally occurring amino acid
  misc_feature (83)..(85): Xaa can be any naturally occurring amino acid
  misc_feature (87)..(88): Xaa can be any naturally occurring amino acid
  misc_feature (90)..(90): Xaa can be any naturally occurring amino acid
  misc_feature (93)..(93): Xaa can be any naturally occurring amino acid
  misc_feature (95)..(101): Xaa can be any naturally occurring amino acid
  misc_feature (103)..(103): Xaa can be any naturally occurring amino acid
  misc_feature (105)..(105): Xaa can be any naturally occurring amino acid
  misc_feature (107)..(108): Xaa can be any naturally occurring amino acid
  misc_feature (110)..(140): Xaa can be any naturally occurring amino acid
  misc_feature (145)..(146): Xaa can be any naturally occurring amino acid
  misc_feature (148)..(182): Xaa can be any naturally occurring amino acid
  misc_feature (185)..(189): Xaa can be any naturally occurring amino acid
  misc_feature (191)..(191): Xaa can be any naturally occurring amino acid
  misc_feature (196)..(219): Xaa can be any naturally occurring amino acid
  misc_feature (221)..(227): Xaa can be any naturally occurring amino acid
  misc_feature (229)..(230): Xaa can be any naturally occurring amino acid
  misc_feature (232)..(237): Xaa can be any naturally occurring amino acid
  misc_feature (239)..(240): Xaa can be any naturally occurring amino acid
  misc_feature (243)..(243): Xaa can be any naturally occurring amino acid
  misc_feature (245)..(246): Xaa can be any naturally occurring amino acid
  misc_feature (248)..(253): Xaa can be any naturally occurring amino acid
  misc_feature (255)..(269): Xaa can be any naturally occurring amino acid
  misc_feature (271)..(328): Xaa can be any naturally occurring amino acid
  misc_feature (330)..(669): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXEXXXWXXLXPDXLXXXXXXXLXLXEXXTXXXXXXXXXXXXXXXXXXXXXXXXXXXXXXXPRVCXXWXXXXXXXXXXXXXXXXXXXXXXXXXXXXXXXXXXXPYXXXXXWXEIDIXXXXXXXXXXXXXXXXXXXXXXXXWXXXXXXXPXXLXXXXXXLXXRSXGXXRXXXXXXLXXXXXXXXXXXXXXXLXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27390 - protein, 2096 aa, artificial
  consensus
  misc_feature (1)..(1252): Xaa can be any naturally occurring amino acid
  misc_feature (1254)..(1255): Xaa can be any naturally occurring amino acid
  misc_feature (1257)..(1270): Xaa can be any naturally occurring amino acid
  misc_feature (1272)..(1272): Xaa can be any naturally occurring amino acid
  misc_feature (1274)..(1299): Xaa can be any naturally occurring amino acid
  misc_feature (1301)..(1303): Xaa can be any naturally occurring amino acid
  misc_feature (1305)..(1437): Xaa can be any naturally occurring amino acid
  misc_feature (1439)..(1441): Xaa can be any naturally occurring amino acid
  misc_feature (1443)..(1444): Xaa can be any naturally occurring amino acid
  misc_feature (1446)..(1452): Xaa can be any naturally occurring amino acid
  misc_feature (1456)..(1456): Xaa can be any naturally occurring amino acid
  misc_feature (1458)..(1459): Xaa can be any naturally occurring amino acid
  misc_feature (1461)..(1461): Xaa can be any naturally occurring amino acid
  misc_feature (1463)..(1485): Xaa can be any naturally occurring amino acid
  misc_feature (1487)..(1487): Xaa can be any naturally occurring amino acid
  misc_feature (1489)..(1521): Xaa can be any naturally occurring amino acid
  misc_feature (1523)..(1527): Xaa can be any naturally occurring amino acid
  misc_feature (1531)..(1578): Xaa can be any naturally occurring amino acid
  misc_feature (1580)..(1584): Xaa can be any naturally occurring amino acid
  misc_feature (1586)..(1598): Xaa can be any naturally occurring amino acid
  misc_feature (1600)..(1601): Xaa can be any naturally occurring amino acid
  misc_feature (1603)..(1662): Xaa can be any naturally occurring amino acid
  misc_feature (1664)..(1671): Xaa can be any naturally occurring amino acid
  misc_feature (1673)..(2096): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXGXXXXXXXXXXXXXXAXKXXXXXXXXXXXXXXXXXXXXXXXXXXEXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXLXXHXXXXXXXHRDXKXXNXLXXXXXXXXXXXXXXXXXXXXXXXDXGXXXXXXXXXXXXXXXXXXXXXXXXXXXXXXXXXGXXXXXAPEXXXXXXXXXXXXXXXXXXXXXXXXXXXXXXXXXXXXXXXXXXXXXXXXDXXXXXGXXXXXXXXXXXXXGXXPXXXXXXXXXXXXXXXXXXXXXXXXXXXXXXXXXXXXXXXXXXXXXXXXXXXXXXXXXXXXRXXXXXXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27391 - protein, 358 aa, artificial
  consensus
  misc_feature (1)..(155): Xaa can be any naturally occurring amino acid
  misc_feature (157)..(157): Xaa can be any naturally occurring amino acid
  misc_feature (159)..(159): Xaa can be any naturally occurring amino acid
  misc_feature (163)..(171): Xaa can be any naturally occurring amino acid
  misc_feature (173)..(174): Xaa can be any naturally occurring amino acid
  misc_feature (176)..(177): Xaa can be any naturally occurring amino acid
  misc_feature (182)..(191): Xaa can be any naturally occurring amino acid
  misc_feature (195)..(195): Xaa can be any naturally occurring amino acid
  misc_feature (199)..(200): Xaa can be any naturally occurring amino acid
  misc_feature (203)..(219): Xaa can be any naturally occurring amino acid
  misc_feature (223)..(223): Xaa can be any naturally occurring amino acid
  misc_feature (226)..(234): Xaa can be any naturally occurring amino acid
  misc_feature (238)..(238): Xaa can be any naturally occurring amino acid
  misc_feature (241)..(241): Xaa can be any naturally occurring amino acid
  misc_feature (244)..(245): Xaa can be any naturally occurring amino acid
  misc_feature (248)..(248): Xaa can be any naturally occurring amino acid
  misc_feature (250)..(251): Xaa can be any naturally occurring amino acid
  misc_feature (254)..(257): Xaa can be any naturally occurring amino acid
  misc_feature (265)..(283): Xaa can be any naturally occurring amino acid
  misc_feature (285)..(301): Xaa can be any naturally occurring amino acid
  misc_feature (303)..(303): Xaa can be any naturally occurring amino acid
  misc_feature (305)..(346): Xaa can be any naturally occurring amino acid
  misc_feature (349)..(358): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXKXHKHXXXXXXXXXGXXGXXAAGAXXXXXXXXXXFALXEKHXXKKXXXXXXXXXXXXXXXXXDPEXAHXXXXXXXXXHKIXEEXAAXXAAXGXXGGXXXXHEHHEKKXXXXXXXXXXXXXXXXXXXEXXXXXXXXXXXXXXXXXGXKXXXXXXXXXXXXXXXXXXXXXXXXXXXXXXXXXXXXXXXXXXHHXXXXXXXXXX

SEQ ID NO: 27392 - protein, 441 aa, artificial
  consensus
  misc_feature (1)..(5): Xaa can be any naturally occurring amino acid
  misc_feature (8)..(9): Xaa can be any naturally occurring amino acid
  misc_feature (12)..(12): Xaa can be any naturally occurring amino acid
  misc_feature (15)..(44): Xaa can be any naturally occurring amino acid
  misc_feature (46)..(47): Xaa can be any naturally occurring amino acid
  misc_feature (53)..(53): Xaa can be any naturally occurring amino acid
  misc_feature (55)..(66): Xaa can be any naturally occurring amino acid
  misc_feature (71)..(72): Xaa can be any naturally occurring amino acid
  misc_feature (74)..(74): Xaa can be any naturally occurring amino acid
  misc_feature (76)..(76): Xaa can be any naturally occurring amino acid
  misc_feature (80)..(82): Xaa can be any naturally occurring amino acid
  misc_feature (90)..(90): Xaa can be any naturally occurring amino acid
  misc_feature (92)..(111): Xaa can be any naturally occurring amino acid
  misc_feature (114)..(115): Xaa can be any naturally occurring amino acid
  misc_feature (117)..(117): Xaa can be any naturally occurring amino acid
  misc_feature (122)..(122): Xaa can be any naturally occurring amino acid
  misc_feature (124)..(125): Xaa can be any naturally occurring amino acid
  misc_feature (127)..(127): Xaa can be any naturally occurring amino acid
  misc_feature (129)..(129): Xaa can be any naturally occurring amino acid
  misc_feature (132)..(132): Xaa can be any naturally occurring amino acid
  misc_feature (134)..(134): Xaa can be any naturally occurring amino acid
  misc_feature (140)..(165): Xaa can be any naturally occurring amino acid
  misc_feature (171)..(174): Xaa can be any naturally occurring amino acid
  misc_feature (176)..(441): Xaa can be any naturally occurring amino acid
XXXXXYKXXPWXLPXXXXXXXXXXXXXXXXXXXXXXXXXXXXXXGXXEWYFFXPXXXXXXXXXXXXDRKYXXGXRXNRAXXXGYWKATGXDXXXXXXXXXXXXXXXXXXXXVGXXKXLVFYXGXXPXGXKTXWXMHEYRXXXXXXXXXXXXXXXXXXXXXXXXXXWVLCRXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27393 - protein, 665 aa, artificial
  consensus
  misc_feature (1)..(487): Xaa can be any naturally occurring amino acid
  misc_feature (490)..(521): Xaa can be any naturally occurring amino acid
  misc_feature (523)..(540): Xaa can be any naturally occurring amino acid
  misc_feature (543)..(544): Xaa can be any naturally occurring amino acid
  misc_feature (547)..(547): Xaa can be any naturally occurring amino acid
  misc_feature (550)..(550): Xaa can be any naturally occurring amino acid
  misc_feature (552)..(552): Xaa can be any naturally occurring amino acid
  misc_feature (554)..(556): Xaa can be any naturally occurring amino acid
  misc_feature (565)..(565): Xaa can be any naturally occurring amino acid
  misc_feature (567)..(567): Xaa can be any naturally occurring amino acid
  misc_feature (570)..(570): Xaa can be any naturally occurring amino acid
  misc_feature (574)..(574): Xaa can be any naturally occurring amino acid
  misc_feature (577)..(580): Xaa can be any naturally occurring amino acid
  misc_feature (582)..(584): Xaa can be any naturally occurring amino acid
  misc_feature (586)..(592): Xaa can be any naturally occurring amino acid
  misc_feature (595)..(606): Xaa can be any naturally occurring amino acid
  misc_feature (608)..(608): Xaa can be any naturally occurring amino acid
  misc_feature (610)..(610): Xaa can be any naturally occurring amino acid
  misc_feature (620)..(626): Xaa can be any naturally occurring amino acid
  misc_feature (628)..(628): Xaa can be any naturally occurring amino acid
  misc_feature (630)..(630): Xaa can be any naturally occurring amino acid
  misc_feature (634)..(635): Xaa can be any naturally occurring amino acid
  misc_feature (637)..(638): Xaa can be any naturally occurring amino acid
  misc_feature (640)..(642): Xaa can be any naturally occurring amino acid
  misc_feature (645)..(646): Xaa can be any naturally occurring amino acid
  misc_feature (649)..(649): Xaa can be any naturally occurring amino acid
  misc_feature (654)..(656): Xaa can be any naturally occurring amino acid
  misc_feature (658)..(665): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGPXXXXXXXXXXXXXXXXXXXXXXXXXXXXXXXXYXXXXXXXXXXXXXXXXXXDEXXDMXLDXDXMXXXTYEELLALXEXIGXVNTXGLXXXXIXXXLXXXXXXXVPXXXXXXXXXXXXSXEXDACIICQEEXXXXXXXGXLXCGHXXHXXCXXXWLXXKNXCPICXXXAXXXXXXXX

SEQ ID NO: 27394 - protein, 567 aa, artificial
  consensus
  misc_feature (1)..(43): Xaa can be any naturally occurring amino acid
  misc_feature (45)..(45): Xaa can be any naturally occurring amino acid
  misc_feature (47)..(47): Xaa can be any naturally occurring amino acid
  misc_feature (50)..(50): Xaa can be any naturally occurring amino acid
  misc_feature (52)..(276): Xaa can be any naturally occurring amino acid
  misc_feature (278)..(279): Xaa can be any naturally occurring amino acid
  misc_feature (281)..(281): Xaa can be any naturally occurring amino acid
  misc_feature (283)..(283): Xaa can be any naturally occurring amino acid
  misc_feature (288)..(291): Xaa can be any naturally occurring amino acid
  misc_feature (293)..(296): Xaa can be any naturally occurring amino acid
  misc_feature (299)..(340): Xaa can be any naturally occurring amino acid
  misc_feature (351)..(357): Xaa can be any naturally occurring amino acid
  misc_feature (361)..(361): Xaa can be any naturally occurring amino acid
  misc_feature (364)..(365): Xaa can be any naturally occurring amino acid
  misc_feature (367)..(368): Xaa can be any naturally occurring amino acid
  misc_feature (370)..(371): Xaa can be any naturally occurring amino acid
  misc_feature (373)..(374): Xaa can be any naturally occurring amino acid
  misc_feature (378)..(378): Xaa can be any naturally occurring amino acid
  misc_feature (381)..(393): Xaa can be any naturally occurring amino acid
  misc_feature (395)..(417): Xaa can be any naturally occurring amino acid
  misc_feature (420)..(424): Xaa can be any naturally occurring amino acid
  misc_feature (433)..(433): Xaa can be any naturally occurring amino acid
  misc_feature (435)..(435): Xaa can be any naturally occurring amino acid
  misc_feature (443)..(443): Xaa can be any naturally occurring amino acid
  misc_feature (445)..(482): Xaa can be any naturally occurring amino acid
  misc_feature (484)..(486): Xaa can be any naturally occurring amino acid
  misc_feature (489)..(495): Xaa can be any naturally occurring amino acid
  misc_feature (502)..(502): Xaa can be any naturally occurring amino acid
  misc_feature (506)..(506): Xaa can be any naturally occurring amino acid
  misc_feature (509)..(567): Xaa can be any naturally occurring amino acid
XXXXXXXXXXXXXXXXXXXXXXXXXXXXXXXXXXXXXXXXXXXTXLXLGXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXKXQXVGWPXXXXPXXXXRKXXXXXXXXXXXXXXXXXXXXXXXXXXXXXXXXXXXXXXXXXXVKVSMDGAPYXXXXXXXLRKXDLXXYXXYXXLXXALEXMFXXXXXXXXXXXXXGXXXXXXXXXXXXXXXXXXXXXXXGSXXXXXTYEDKDGDXMXLVGDVPWXMXXXXXXXXXXXXXXXXXXXXXXXXXXXXXXXXXXXXXXFXXXCKXXXXXXXRLRIMKXSEAXGLXXXXXXXXXXXXXXXXXXXXXXXXXXXXXXXXXXXXXXXXXXXXXXXXXXXXXXXXXXX

SEQ ID NO: 27395 - protein, 611 aa, artificial
  consensus
  misc_feature (1)..(17): Xaa can be any naturally occurring amino acid
  misc_feature (19)..(24): Xaa can be any naturally occurring amino acid
  misc_feature (27)..(27): Xaa can be any naturally occurring amino acid
  misc_feature (30)..(30): Xaa can be any naturally occurring amino acid
  misc_feature (32)..(32): Xaa can be any naturally occurring amino acid
  misc_feature (34)..(52): Xaa can be any naturally occurring amino acid
  misc_feature (55)..(55): Xaa can be any naturally occurring amino acid
  misc_feature (63)..(64): Xaa can be any naturally occurring amino acid
  misc_feature (67)..(137): Xaa can be any naturally occurring amino acid
  misc_feature (139)..(139): Xaa can be any naturally occurring amino acid
  misc_feature (141)..(141): Xaa can be any naturally occurring amino acid
  misc_feature (145)..(194): Xaa can be any naturally occurring amino acid
  misc_feature (197)..(197): Xaa can be any naturally occurring amino acid
  misc_feature (200)..(200): Xaa can be any naturally occurring amino acid
  misc_feature (206)..(206): Xaa can be any naturally occurring amino acid
  misc_feature (208)..(217): Xaa can be any naturally occurring amino acid
  misc_feature (223)..(224): Xaa can be any naturally occurring amino acid
  misc_feature (227)..(229): Xaa can be any naturally occurring amino acid
  misc_feature (236)..(236): Xaa can be any naturally occurring amino acid
  misc_feature (239)..(240): Xaa can be any naturally occurring amino acid
  misc_feature (245)..(245): Xaa can be any naturally occurring amino acid
  misc_feature (249)..(249): Xaa can be any naturally occurring amino acid
  misc_feature (256)..(257): Xaa can be any naturally occurring amino acid
  misc_feature (261)..(261): Xaa can be any naturally occurring amino acid
  misc_feature (263)..(611): Xaa can be any naturally occurring amino acid
XXXXXXXXXXXXXXXXXRXXXXXXCDXCEXAXAXXXXXXXXXXXXXXXXXXXFCXADEAALCXXCDXXXXXXXXXXXXXXXXXXXXXXXXXXXXXXXXXXXXXXXXXXXXXXXXXXXXXXXXXXXXXXXXXXXXXXXKXHXCNKXXXXXXXXXXXXXXXXXXXXXXXXXXXXXXXXXXXXXXXXXXXXXXXXXXLAXRHXRVGLAXPXXXXXXXXXXCDICEXXAPXXXAFFYCEXDGXXSLCLXCDMXVHVGGKXXRTHXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27396 - protein, 303 aa, artificial
  consensus
  misc_feature (2)..(2): Xaa can be any naturally occurring amino acid
  misc_feature (4)..(49): Xaa can be any naturally occurring amino acid
  misc_feature (52)..(56): Xaa can be any naturally occurring amino acid
  misc_feature (58)..(107): Xaa can be any naturally occurring amino acid
  misc_feature (109)..(112): Xaa can be any naturally occurring amino acid
  misc_feature (114)..(168): Xaa can be any naturally occurring amino acid
  misc_feature (170)..(170): Xaa can be any naturally occurring amino acid
  misc_feature (172)..(173): Xaa can be any naturally occurring amino acid
  misc_feature (175)..(175): Xaa can be any naturally occurring amino acid
  misc_feature (177)..(214): Xaa can be any naturally occurring amino acid
  misc_feature (216)..(216): Xaa can be any naturally occurring amino acid
  misc_feature (218)..(218): Xaa can be any naturally occurring amino acid
  misc_feature (221)..(246): Xaa can be any naturally occurring amino acid
  misc_feature (248)..(249): Xaa can be any naturally occurring amino acid
  misc_feature (251)..(251): Xaa can be any naturally occurring amino acid
  misc_feature (253)..(254): Xaa can be any naturally occurring amino acid
  misc_feature (256)..(299): Xaa can be any naturally occurring amino acid
  misc_feature (301)..(303): Xaa can be any naturally occurring amino acid
GXAXXXXXXXXXXXXXXXXXXXXXXXXXXXXXXXXXXXXXXXXXXXXXXAEXXXXXQXXXXXXXXXXXXXXXXXXXXXXXXXXXXXXXXXXXXXXXXXXXXXXXXXXFXXXXEXXXXXXXXXXXXXXXXXXXXXXXXXXXXXXXXXXXXXXXXXXXXXXXXXXXXXXXPXLXXTXGXXXXXXXXXXXXXXXXXXXXXXXXXXXXXXXXXXXXXXQXWXRWXXXXXXXXXXXXXXXXXXXXXXXXXXPXXQXLXXCXXXXXXXXXXXXXXXXXXXXXXXXXXXXXXXXXXXXXXXXXXXXWXXX

SEQ ID NO: 27397 - protein, 1128 aa, artificial
  consensus
  misc_feature (1)..(72): Xaa can be any naturally occurring amino acid
  misc_feature (76)..(85): Xaa can be any naturally occurring amino acid
  misc_feature (88)..(88): Xaa can be any naturally occurring amino acid
  misc_feature (92)..(92): Xaa can be any naturally occurring amino acid
  misc_feature (94)..(99): Xaa can be any naturally occurring amino acid
  misc_feature (106)..(115): Xaa can be any naturally occurring amino acid
  misc_feature (118)..(194): Xaa can be any naturally occurring amino acid
  misc_feature (196)..(196): Xaa can be any naturally occurring amino acid
  misc_feature (199)..(200): Xaa can be any naturally occurring amino acid
  misc_feature (203)..(209): Xaa can be any naturally occurring amino acid
  misc_feature (211)..(211): Xaa can be any naturally occurring amino acid
  misc_feature (213)..(242): Xaa can be any naturally occurring amino acid
  misc_feature (244)..(245): Xaa can be any naturally occurring amino acid
  misc_feature (251)..(384): Xaa can be any naturally occurring amino acid
  misc_feature (386)..(387): Xaa can be any naturally occurring amino acid
  misc_feature (389)..(391): Xaa can be any naturally occurring amino acid
  misc_feature (394)..(404): Xaa can be any naturally occurring amino acid
  misc_feature (406)..(410): Xaa can be any naturally occurring amino acid
  misc_feature (412)..(421): Xaa can be any naturally occurring amino acid
  misc_feature (423)..(424): Xaa can be any naturally occurring amino acid
  misc_feature (426)..(426): Xaa can be any naturally occurring amino acid
  misc_feature (428)..(431): Xaa can be any naturally occurring amino acid
  misc_feature (433)..(460): Xaa can be any naturally occurring amino acid
  misc_feature (462)..(463): Xaa can be any naturally occurring amino acid
  misc_feature (468)..(474): Xaa can be any naturally occurring amino acid
  misc_feature (477)..(477): Xaa can be any naturally occurring amino acid
  misc_feature (480)..(497): Xaa can be any naturally occurring amino acid
  misc_feature (500)..(500): Xaa can be any naturally occurring amino acid
  misc_feature (502)..(506): Xaa can be any naturally occurring amino acid
  misc_feature (508)..(540): Xaa can be any naturally occurring amino acid
  misc_feature (543)..(543): Xaa can be any naturally occurring amino acid
  misc_feature (546)..(585): Xaa can be any naturally occurring amino acid
  misc_feature (588)..(589): Xaa can be any naturally occurring amino acid
  misc_feature (591)..(591): Xaa can be any naturally occurring amino acid
  misc_feature (593)..(593): Xaa can be any naturally occurring amino acid
  misc_feature (595)..(599): Xaa can be any naturally occurring amino acid
  misc_feature (601)..(601): Xaa can be any naturally occurring amino acid
  misc_feature (603)..(604): Xaa can be any naturally occurring amino acid
  misc_feature (606)..(606): Xaa can be any naturally occurring amino acid
  misc_feature (608)..(617): Xaa can be any naturally occurring amino acid
  misc_feature (619)..(1027): Xaa can be any naturally occurring amino acid
  misc_feature (1029)..(1128): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXKRRXXXXXXXXXXGLXKKAXEXXXXXXSVLCDAXXXXXXXXXXEVXXXXXXXXXXXXXXXXXXXXXXXXXXXXXXXXXXXXXXXXXXXXXXXXXXXXXXXXXXXXXXXXXXXXXXXXXXXXXIXFSXXGKXXXXXXXLXEXXXXXXXXXXXXXXXXXXXXXXXXXXXXXXMXXILERYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXEXXXLKXXXXXXXXXXXEXXXXXQXXXXXXXXXXHXXGXEXXXXLXXXXXXXXXXXXXXXXXXXXXXXXXXXXLXXKELQXXXXXXXLEXQLXXXXXXXXXXXXXXXXXXLKXIXXXXXRXXXXXXXXXXXXXXXXXXXXXXXXXXXXXXXXXRKXQLXXXXXXXXXXXXXXXXXXXXXXXXXXXXXXXXXXXXXXXXSIXXLXQXKXXXXXEXNXXLXKXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27398 - protein, 1263 aa, artificial
  consensus
  misc_feature (1)..(27): Xaa can be any naturally occurring amino acid
  misc_feature (31)..(33): Xaa can be any naturally occurring amino acid
  misc_feature (39)..(39): Xaa can be any naturally occurring amino acid
  misc_feature (43)..(157): Xaa can be any naturally occurring amino acid
  misc_feature (160)..(205): Xaa can be any naturally occurring amino acid
  misc_feature (209)..(216): Xaa can be any naturally occurring amino acid
  misc_feature (218)..(218): Xaa can be any naturally occurring amino acid
  misc_feature (220)..(240): Xaa can be any naturally occurring amino acid
  misc_feature (247)..(260): Xaa can be any naturally occurring amino acid
  misc_feature (263)..(264): Xaa can be any naturally occurring amino acid
  misc_feature (267)..(288): Xaa can be any naturally occurring amino acid
  misc_feature (290)..(290): Xaa can be any naturally occurring amino acid
  misc_feature (293)..(294): Xaa can be any naturally occurring amino acid
  misc_feature (297)..(298): Xaa can be any naturally occurring amino acid
  misc_feature (300)..(311): Xaa can be any naturally occurring amino acid
  misc_feature (313)..(338): Xaa can be any naturally occurring amino acid
  misc_feature (340)..(344): Xaa can be any naturally occurring amino acid
  misc_feature (346)..(393): Xaa can be any naturally occurring amino acid
  misc_feature (395)..(396): Xaa can be any naturally occurring amino acid
  misc_feature (401)..(418): Xaa can be any naturally occurring amino acid
  misc_feature (420)..(420): Xaa can be any naturally occurring amino acid
  misc_feature (422)..(436): Xaa can be any naturally occurring amino acid
  misc_feature (438)..(531): Xaa can be any naturally occurring amino acid
  misc_feature (533)..(534): Xaa can be any naturally occurring amino acid
  misc_feature (536)..(559): Xaa can be any naturally occurring amino acid
  misc_feature (562)..(577): Xaa can be any naturally occurring amino acid
  misc_feature (579)..(580): Xaa can be any naturally occurring amino acid
  misc_feature (582)..(606): Xaa can be any naturally occurring amino acid
  misc_feature (608)..(608): Xaa can be any naturally occurring amino acid
  misc_feature (610)..(610): Xaa can be any naturally occurring amino acid
  misc_feature (612)..(613): Xaa can be any naturally occurring amino acid
  misc_feature (615)..(621): Xaa can be any naturally occurring amino acid
  misc_feature (624)..(634): Xaa can be any naturally occurring amino acid
  misc_feature (637)..(637): Xaa can be any naturally occurring amino acid
  misc_feature (640)..(645): Xaa can be any naturally occurring amino acid
  misc_feature (647)..(653): Xaa can be any naturally occurring amino acid
  misc_feature (655)..(671): Xaa can be any naturally occurring amino acid
  misc_feature (674)..(676): Xaa can be any naturally occurring amino acid
  misc_feature (679)..(679): Xaa can be any naturally occurring amino acid
  misc_feature (682)..(683): Xaa can be any naturally occurring amino acid
  misc_feature (685)..(690): Xaa can be any naturally occurring amino acid
  misc_feature (692)..(717): Xaa can be any naturally occurring amino acid
  misc_feature (720)..(720): Xaa can be any naturally occurring amino acid
  misc_feature (723)..(730): Xaa can be any naturally occurring amino acid
  misc_feature (732)..(788): Xaa can be any naturally occurring amino acid
  misc_feature (790)..(790): Xaa can be any naturally occurring amino acid
  misc_feature (792)..(793): Xaa can be any naturally occurring amino acid
  misc_feature (795)..(795): Xaa can be any naturally occurring amino acid
  misc_feature (797)..(1003): Xaa can be any naturally occurring amino acid
  misc_feature (1005)..(1263): Xaa can be any naturally occurring amino acid
XXXXXXXXXXXXXXXXXXXXXXXXXXXIENXXXRQVTFXKRRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLXXXXXXXXXXXXXXXXXXXXXXXXXXXXXXXXXXXXXXXXXXXXXXLKKXXXXXXXXAXEXXXXXXXXXXXXXXXXXXXXXSVLCDAXXXXXXXXXXXXXXEVXXALXXXXXXXXXXXXXXXXXXXXXXIXFSXXGKXXLXXXXXXXXXXXXEXXXXXXXXXXXXXXXXXXXXXXXXXXYXXXXXSXXXXXXXXXXXXXXXXXXXXXXXXXXXXXXXXXXXXXXXXXXXXXXXXMXXILERXXXXXXXXXXXXXXXXXXYXRXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXEXXXXXXXXXXXXXXXXXXXXXXXXLKXXXXXXXXXXXXXXXXEXXQXXXXXXXXXXXXXXXXXXXXXXXXXGXEXLXXLXXXXXXXKEXXXXXXXXXXXLQXLEXXXXXXQXXXXXXXLXXXXXXXXXXXXXXXXXLKXXXIRXRKXXLXXXXXXIXXXXXXXXXXXXXXXXXXXXXXXXXXLQXKEXXXXXXXXLXXXXXXXXXXXXXXXXXXXXXXXXXXXXXXXXXXXXXXXXXXXXXXXXXXXXXXXXXEXNXXLXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27399 - protein, 1007 aa, artificial
  consensus
  misc_feature (1)..(256): Xaa can be any naturally occurring amino acid
  misc_feature (258)..(261): Xaa can be any naturally occurring amino acid
  misc_feature (263)..(297): Xaa can be any naturally occurring amino acid
  misc_feature (299)..(306): Xaa can be any naturally occurring amino acid
  misc_feature (311)..(317): Xaa can be any naturally occurring amino acid
  misc_feature (319)..(321): Xaa can be any naturally occurring amino acid
  misc_feature (323)..(324): Xaa can be any naturally occurring amino acid
  misc_feature (326)..(334): Xaa can be any naturally occurring amino acid
  misc_feature (336)..(351): Xaa can be any naturally occurring amino acid
  misc_feature (353)..(550): Xaa can be any naturally occurring amino acid
  misc_feature (552)..(565): Xaa can be any naturally occurring amino acid
  misc_feature (567)..(581): Xaa can be any naturally occurring amino acid
  misc_feature (583)..(586): Xaa can be any naturally occurring amino acid
  misc_feature (588)..(588): Xaa can be any naturally occurring amino acid
  misc_feature (590)..(616): Xaa can be any naturally occurring amino acid
  misc_feature (619)..(620): Xaa can be any naturally occurring amino acid
  misc_feature (622)..(627): Xaa can be any naturally occurring amino acid
  misc_feature (629)..(634): Xaa can be any naturally occurring amino acid
  misc_feature (636)..(636): Xaa can be any naturally occurring amino acid
  misc_feature (638)..(642): Xaa can be any naturally occurring amino acid
  misc_feature (645)..(645): Xaa can be any naturally occurring amino acid
  misc_feature (647)..(647): Xaa can be any naturally occurring amino acid
  misc_feature (650)..(650): Xaa can be any naturally occurring amino acid
  misc_feature (652)..(652): Xaa can be any naturally occurring amino acid
  misc_feature (654)..(660): Xaa can be any naturally occurring amino acid
  misc_feature (662)..(666): Xaa can be any naturally occurring amino acid
  misc_feature (668)..(669): Xaa can be any naturally occurring amino acid
  misc_feature (671)..(672): Xaa can be any naturally occurring amino acid
  misc_feature (674)..(699): Xaa can be any naturally occurring amino acid
  misc_feature (705)..(709): Xaa can be any naturally occurring amino acid
  misc_feature (711)..(713): Xaa can be any naturally occurring amino acid
  misc_feature (716)..(726): Xaa can be any naturally occurring amino acid
  misc_feature (729)..(730): Xaa can be any naturally occurring amino acid
  misc_feature (733)..(733): Xaa can be any naturally occurring amino acid
  misc_feature (735)..(742): Xaa can be any naturally occurring amino acid
  misc_feature (745)..(746): Xaa can be any naturally occurring amino acid
  misc_feature (748)..(748): Xaa can be any naturally occurring amino acid
  misc_feature (751)..(758): Xaa can be any naturally occurring amino acid
  misc_feature (760)..(765): Xaa can be any naturally occurring amino acid
  misc_feature (767)..(767): Xaa can be any naturally occurring amino acid
  misc_feature (769)..(769): Xaa can be any naturally occurring amino acid
  misc_feature (772)..(773): Xaa can be any naturally occurring amino acid
  misc_feature (775)..(776): Xaa can be any naturally occurring amino acid
  misc_feature (779)..(834): Xaa can be any naturally occurring amino acid
  misc_feature (836)..(847): Xaa can be any naturally occurring amino acid
  misc_feature (849)..(879): Xaa can be any naturally occurring amino acid
  misc_feature (881)..(1007): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXPXXXXXXXXXXXXXXXXXXXXXXXXXXXXXXXXXXXPXXXXXXXXMDTVXXXXXXXAXXXAXXGXXXXXXXXXHXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXLXXXXXXXXXXXXXXXDXXXXGXSXXXXXXXXXXXXXXXXXXXXXXXXXXXGNXXTXXXXXXLXXXXXXGXDXXXXXVGXGXGSXCXTXXXXXXXGXXXXXPXXQXXAXXXXXXXXXXXXXXXXXXXXXXXXXXIADGGXXXXXGXXXKAXXXXXXXXXXXGAXXVMXGXXXXXXXXAGXXEXPGXXXXXXXXGXXXXXXKXYXGMXXSXXAMXXXXXXXXXXXXXXXXXXXXXXXXXXXXXXXXXXXXXXXXXXXXXXXXXXXXXXXXGXXXXXXXXXXXXGXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27400 - protein, 454 aa, artificial
  consensus
  misc_feature (1)..(4): Xaa can be any naturally occurring amino acid
  misc_feature (6)..(37): Xaa can be any naturally occurring amino acid
  misc_feature (39)..(43): Xaa can be any naturally occurring amino acid
  misc_feature (45)..(47): Xaa can be any naturally occurring amino acid
  misc_feature (49)..(59): Xaa can be any naturally occurring amino acid
  misc_feature (61)..(64): Xaa can be any naturally occurring amino acid
  misc_feature (66)..(101): Xaa can be any naturally occurring amino acid
  misc_feature (103)..(103): Xaa can be any naturally occurring amino acid
  misc_feature (107)..(134): Xaa can be any naturally occurring amino acid
  misc_feature (136)..(143): Xaa can be any naturally occurring amino acid
  misc_feature (145)..(159): Xaa can be any naturally occurring amino acid
  misc_feature (161)..(163): Xaa can be any naturally occurring amino acid
  misc_feature (165)..(166): Xaa can be any naturally occurring amino acid
  misc_feature (168)..(168): Xaa can be any naturally occurring amino acid
  misc_feature (170)..(173): Xaa can be any naturally occurring amino acid
  misc_feature (175)..(176): Xaa can be any naturally occurring amino acid
  misc_feature (179)..(188): Xaa can be any naturally occurring amino acid
  misc_feature (191)..(191): Xaa can be any naturally occurring amino acid
  misc_feature (194)..(194): Xaa can be any naturally occurring amino acid
  misc_feature (197)..(208): Xaa can be any naturally occurring amino acid
  misc_feature (210)..(219): Xaa can be any naturally occurring amino acid
  misc_feature (223)..(266): Xaa can be any naturally occurring amino acid
  misc_feature (268)..(279): Xaa can be any naturally occurring amino acid
  misc_feature (281)..(332): Xaa can be any naturally occurring amino acid
  misc_feature (334)..(335): Xaa can be any naturally occurring amino acid
  misc_feature (340)..(346): Xaa can be any naturally occurring amino acid
  misc_feature (350)..(350): Xaa can be any naturally occurring amino acid
  misc_feature (352)..(362): Xaa can be any naturally occurring amino acid
  misc_feature (365)..(366): Xaa can be any naturally occurring amino acid
  misc_feature (369)..(369): Xaa can be any naturally occurring amino acid
  misc_feature (371)..(384): Xaa can be any naturally occurring amino acid
  misc_feature (386)..(397): Xaa can be any naturally occurring amino acid
  misc_feature (399)..(404): Xaa can be any naturally occurring amino acid
  misc_feature (406)..(408): Xaa can be any naturally occurring amino acid
  misc_feature (410)..(426): Xaa can be any naturally occurring amino acid
  misc_feature (429)..(438): Xaa can be any naturally occurring amino acid
  misc_feature (440)..(454): Xaa can be any naturally occurring amino acid
XXXXGXXXXXXXXXXXXXXXXXXXXXXXXXXXXXXXXPXXXXXVXXXLXXXXXXXXXXXEXXXXGXXXXXXXXXXXXXXXXXXXXXXXXXXXXXXXXXXXXLXDTGXXXXXXXXXXXXXXXXXXXXXXXXXXXXGXXXXXXXXPXXXXXXXXXXXXXXXLXXXGXXPXDXXXXIXXSHXXXXXXXXXXLHXDHXGGXXXXXXXXXXXXFXXXXXXXXXXEYEXXXXXXXXXXXXXXXXXXXXXXXXXXXXXXXXXXXXXXXXXXXXGXXXXXXXXXXXXGXXXXXXXXXXXXXXXXXXXXXXXXXXXXXXXXXXXXXXXXXXXXXXXXXXXXLXXTPGHXXXXXXXPGHXSXXXXXXXXXXXLLXXDAXYXXXXXXXXXXXXXXPXXXXXXXXXXXXDXXXXXXSXXXLXXXXXXXXXXXXXXXXXHDXXXXXXXXXXPXXXXXXXXXXXXXXX

SEQ ID NO: 27401 - protein, 815 aa, artificial
  consensus
  misc_feature (1)..(140): Xaa can be any naturally occurring amino acid
  misc_feature (144)..(148): Xaa can be any naturally occurring amino acid
  misc_feature (152)..(191): Xaa can be any naturally occurring amino acid
  misc_feature (193)..(196): Xaa can be any naturally occurring amino acid
  misc_feature (198)..(200): Xaa can be any naturally occurring amino acid
  misc_feature (202)..(203): Xaa can be any naturally occurring amino acid
  misc_feature (205)..(250): Xaa can be any naturally occurring amino acid
  misc_feature (252)..(271): Xaa can be any naturally occurring amino acid
  misc_feature (273)..(274): Xaa can be any naturally occurring amino acid
  misc_feature (276)..(276): Xaa can be any naturally occurring amino acid
  misc_feature (283)..(327): Xaa can be any naturally occurring amino acid
  misc_feature (330)..(360): Xaa can be any naturally occurring amino acid
  misc_feature (362)..(362): Xaa can be any naturally occurring amino acid
  misc_feature (364)..(364): Xaa can be any naturally occurring amino acid
  misc_feature (366)..(367): Xaa can be any naturally occurring amino acid
  misc_feature (369)..(377): Xaa can be any naturally occurring amino acid
  misc_feature (379)..(392): Xaa can be any naturally occurring amino acid
  misc_feature (394)..(396): Xaa can be any naturally occurring amino acid
  misc_feature (398)..(403): Xaa can be any naturally occurring amino acid
  misc_feature (405)..(407): Xaa can be any naturally occurring amino acid
  misc_feature (409)..(409): Xaa can be any naturally occurring amino acid
  misc_feature (411)..(411): Xaa can be any naturally occurring amino acid
  misc_feature (413)..(415): Xaa can be any naturally occurring amino acid
  misc_feature (417)..(417): Xaa can be any naturally occurring amino acid
  misc_feature (420)..(422): Xaa can be any naturally occurring amino acid
  misc_feature (425)..(428): Xaa can be any naturally occurring amino acid
  misc_feature (430)..(730): Xaa can be any naturally occurring amino acid
  misc_feature (732)..(733): Xaa can be any naturally occurring amino acid
  misc_feature (735)..(735): Xaa can be any naturally occurring amino acid
  misc_feature (737)..(739): Xaa can be any naturally occurring amino acid
  misc_feature (741)..(741): Xaa can be any naturally occurring amino acid
  misc_feature (743)..(746): Xaa can be any naturally occurring amino acid
  misc_feature (749)..(758): Xaa can be any naturally occurring amino acid
  misc_feature (761)..(764): Xaa can be any naturally occurring amino acid
  misc_feature (769)..(815): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTGXXXXXGIGXXXXXXXXXXXXXXXXXXXXXXXXXXXXXXXXXXXXXXXXAXXXXLXXXGXXVXXXXXXXXXXXXXXXXXXXXXXXXXXXXXXXXXXXXXXXXXXXXXXDXXXXXXXXXXXXXXXXXXXXGXXDXLVNNAGXXXXXXXXXXXXXXXXXXXXXXXXXXXXXXXXXXXXXXXXXXXXXNLXXXXXXXXXXXXXXXXXXXXXXXXXXXXXXXGXIXNXXSXXXXXXXXXGXXXXXXXXXXXXXXYXXXKXXXXXXTXXXAXEXAXXXIXVNXXXPGXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXRXGXXXEXAXXXXFLXXXXXXXXXXTGXXXXVDGGXXXXXXXXXXXXXXXXXXXXXXXXXXXXXXXXXXXXXXXXXXXXXXX

SEQ ID NO: 27402 - protein, 689 aa, artificial
  consensus
  misc_feature (1)..(36): Xaa can be any naturally occurring amino acid
  misc_feature (38)..(38): Xaa can be any naturally occurring amino acid
  misc_feature (42)..(46): Xaa can be any naturally occurring amino acid
  misc_feature (50)..(50): Xaa can be any naturally occurring amino acid
  misc_feature (52)..(56): Xaa can be any naturally occurring amino acid
  misc_feature (58)..(62): Xaa can be any naturally occurring amino acid
  misc_feature (64)..(65): Xaa can be any naturally occurring amino acid
  misc_feature (67)..(96): Xaa can be any naturally occurring amino acid
  misc_feature (98)..(113): Xaa can be any naturally occurring amino acid
  misc_feature (115)..(135): Xaa can be any naturally occurring amino acid
  misc_feature (137)..(141): Xaa can be any naturally occurring amino acid
  misc_feature (143)..(160): Xaa can be any naturally occurring amino acid
  misc_feature (164)..(164): Xaa can be any naturally occurring amino acid
  misc_feature (167)..(215): Xaa can be any naturally occurring amino acid
  misc_feature (218)..(244): Xaa can be any naturally occurring amino acid
  misc_feature (246)..(246): Xaa can be any naturally occurring amino acid
  misc_feature (248)..(248): Xaa can be any naturally occurring amino acid
  misc_feature (250)..(251): Xaa can be any naturally occurring amino acid
  misc_feature (253)..(273): Xaa can be any naturally occurring amino acid
  misc_feature (275)..(277): Xaa can be any naturally occurring amino acid
  misc_feature (279)..(284): Xaa can be any naturally occurring amino acid
  misc_feature (286)..(288): Xaa can be any naturally occurring amino acid
  misc_feature (290)..(290): Xaa can be any naturally occurring amino acid
  misc_feature (292)..(292): Xaa can be any naturally occurring amino acid
  misc_feature (294)..(296): Xaa can be any naturally occurring amino acid
  misc_feature (298)..(298): Xaa can be any naturally occurring amino acid
  misc_feature (301)..(303): Xaa can be any naturally occurring amino acid
  misc_feature (306)..(310): Xaa can be any naturally occurring amino acid
  misc_feature (312)..(346): Xaa can be any naturally occurring amino acid
  misc_feature (348)..(353): Xaa can be any naturally occurring amino acid
  misc_feature (355)..(355): Xaa can be any naturally occurring amino acid
  misc_feature (357)..(357): Xaa can be any naturally occurring amino acid
  misc_feature (359)..(359): Xaa can be any naturally occurring amino acid
  misc_feature (361)..(361): Xaa can be any naturally occurring amino acid
  misc_feature (363)..(366): Xaa can be any naturally occurring amino acid
  misc_feature (369)..(377): Xaa can be any naturally occurring amino acid
  misc_feature (380)..(383): Xaa can be any naturally occurring amino acid
  misc_feature (385)..(385): Xaa can be any naturally occurring amino acid
  misc_feature (388)..(689): Xaa can be any naturally occurring amino acid
XXXXXXXXXXXXXXXXXXXXXXXXXXXXXXXXXXXXAXVTGXXXXXGIGXAXXXXXLXXXXXGXXVXXXXXXXXXXXXXXXXXXXXXXXXXXXXXXGXXXXXXXXXXXXXXXXDXXXXXXXXXXXXXXXXXXXXXGXXXXXLXXXXXXXXXXXXXXXXXXVNNXAGXXXXXXXXXXXXXXXXXXXXXXXXXXXXXXXXXXXXXXXXXXXXXXXXXNLXXXXXXXXXXXXXXXXXXXXXXXXXXXGXIXNXXSXXXXXXXXXXXXXXXXXXXXXYXXXKXXXXXXTXXXAXEXAXXXIXVNXXXPGXXXXXTXXXXXXXXXXXXXXXXXXXXXXXXXXXXXXXXXXXPXXXXXXRXGXPXEXAXXXXFLXXXXXXXXXTGXXXXVXGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27403 - protein, 1279 aa, artificial
  consensus
  misc_feature (1)..(280): Xaa can be any naturally occurring amino acid
  misc_feature (282)..(282): Xaa can be any naturally occurring amino acid
  misc_feature (284)..(314): Xaa can be any naturally occurring amino acid
  misc_feature (317)..(323): Xaa can be any naturally occurring amino acid
  misc_feature (327)..(366): Xaa can be any naturally occurring amino acid
  misc_feature (368)..(389): Xaa can be any naturally occurring amino acid
  misc_feature (391)..(395): Xaa can be any naturally occurring amino acid
  misc_feature (398)..(398): Xaa can be any naturally occurring amino acid
  misc_feature (400)..(472): Xaa can be any naturally occurring amino acid
  misc_feature (474)..(655): Xaa can be any naturally occurring amino acid
  misc_feature (657)..(661): Xaa can be any naturally occurring amino acid
  misc_feature (663)..(680): Xaa can be any naturally occurring amino acid
  misc_feature (683)..(714): Xaa can be any naturally occurring amino acid
  misc_feature (716)..(717): Xaa can be any naturally occurring amino acid
  misc_feature (719)..(719): Xaa can be any naturally occurring amino acid
  misc_feature (721)..(747): Xaa can be any naturally occurring amino acid
  misc_feature (750)..(778): Xaa can be any naturally occurring amino acid
  misc_feature (780)..(784): Xaa can be any naturally occurring amino acid
  misc_feature (786)..(787): Xaa can be any naturally occurring amino acid
  misc_feature (789)..(790): Xaa can be any naturally occurring amino acid
  misc_feature (792)..(794): Xaa can be any naturally occurring amino acid
  misc_feature (796)..(810): Xaa can be any naturally occurring amino acid
  misc_feature (812)..(814): Xaa can be any naturally occurring amino acid
  misc_feature (816)..(823): Xaa can be any naturally occurring amino acid
  misc_feature (825)..(827): Xaa can be any naturally occurring amino acid
  misc_feature (829)..(829): Xaa can be any naturally occurring amino acid
  misc_feature (831)..(831): Xaa can be any naturally occurring amino acid
  misc_feature (833)..(839): Xaa can be any naturally occurring amino acid
  misc_feature (841)..(842): Xaa can be any naturally occurring amino acid
  misc_feature (844)..(846): Xaa can be any naturally occurring amino acid
  misc_feature (849)..(851): Xaa can be any naturally occurring amino acid
  misc_feature (853)..(916): Xaa can be any naturally occurring amino acid
  misc_feature (918)..(919): Xaa can be any naturally occurring amino acid
  misc_feature (921)..(921): Xaa can be any naturally occurring amino acid
  misc_feature (923)..(925): Xaa can be any naturally occurring amino acid
  misc_feature (927)..(935): Xaa can be any naturally occurring amino acid
  misc_feature (938)..(952): Xaa can be any naturally occurring amino acid
  misc_feature (955)..(958): Xaa can be any naturally occurring amino acid
  misc_feature (963)..(1279): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXVXXXXXXXXXXXXXXXXXXXXXXXXXXXXXXXTGXXXXXXXGIGXXXXXXXXXXXXXXXXXXXXXXXXXXXXXXXXXXXXXXXXAXXXXXXXXXXXXXXXXXXXXXXLXXXXXGAXVXXXXXXXXXXXXXXXXXXXXXXXXXXXXXXXXXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXLXXXXXXXXXXXXXXXXXXVNXXXXXXXXXXXXXXXXXXXXXXXXXXXXXXXXNXXAXGXXXXXXXXXXXXXXXXXXXXXXXXXXXNLXXXXXXXXXXXXXXXXXXXXXXXXXXXXXGXXXXXIXXNXXSXXXGXXXXXXXXXXXXXXXYXXXKXXXXXXXXTXXXAXEXAXXXXXXXIXXNXXXPGXXXTXXXXXXXXXXXXXXXXXXXXXXXXXXXXXXXXXXXXXXXXXXXXXXXXXXXXXXXXXXXXXXXXPXXRXGXXXPXXXXXXXXXFLXXXXXXXXXXXXXXXTGXXXXVDGGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27404 - protein, 520 aa, artificial
  consensus
  misc_feature (1)..(4): Xaa can be any naturally occurring amino acid
  misc_feature (6)..(6): Xaa can be any naturally occurring amino acid
  misc_feature (9)..(93): Xaa can be any naturally occurring amino acid
  misc_feature (96)..(97): Xaa can be any naturally occurring amino acid
  misc_feature (99)..(106): Xaa can be any naturally occurring amino acid
  misc_feature (109)..(118): Xaa can be any naturally occurring amino acid
  misc_feature (121)..(123): Xaa can be any naturally occurring amino acid
  misc_feature (125)..(127): Xaa can be any naturally occurring amino acid
  misc_feature (129)..(241): Xaa can be any naturally occurring amino acid
  misc_feature (245)..(250): Xaa can be any naturally occurring amino acid
  misc_feature (252)..(254): Xaa can be any naturally occurring amino acid
  misc_feature (256)..(323): Xaa can be any naturally occurring amino acid
  misc_feature (325)..(326): Xaa can be any naturally occurring amino acid
  misc_feature (328)..(386): Xaa can be any naturally occurring amino acid
  misc_feature (388)..(395): Xaa can be any naturally occurring amino acid
  misc_feature (397)..(419): Xaa can be any naturally occurring amino acid
  misc_feature (421)..(422): Xaa can be any naturally occurring amino acid
  misc_feature (424)..(424): Xaa can be any naturally occurring amino acid
  misc_feature (426)..(454): Xaa can be any naturally occurring amino acid
  misc_feature (456)..(457): Xaa can be any naturally occurring amino acid
  misc_feature (459)..(464): Xaa can be any naturally occurring amino acid
  misc_feature (467)..(473): Xaa can be any naturally occurring amino acid
  misc_feature (475)..(487): Xaa can be any naturally occurring amino acid
  misc_feature (489)..(489): Xaa can be any naturally occurring amino acid
  misc_feature (491)..(493): Xaa can be any naturally occurring amino acid
  misc_feature (495)..(506): Xaa can be any naturally occurring amino acid
  misc_feature (508)..(511): Xaa can be any naturally occurring amino acid
  misc_feature (513)..(520): Xaa can be any naturally occurring amino acid
XXXXGXGVXXXXXXXXXXXXXXXXXXXXXXXXXXXXXXXXXXXXXXXXXXXXXXXXXXXXXXXXXXXXXXXXXXXXXXXXXXXXXXXXXXXXXFFXXLXXXXXXXXPSXXXXXXXXXXDGXXXSXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSRXXXXXXRXXXLXXXXXXXXXXXXXXXXXXXXXXXXXXXXXXXXXXXXXXXXXXXXXXXXXXXXXXXXXXXXXXXXXXXXVXXGXXXXXXXXXXXXXXXXXXXXXXXXXXXXXXXXXXXXXXXXXXXXXXXXXXXXXXXXXXXPXXXXXXXXGXXXXXXXXXXXXXXXXXXXXXXXGXXPXAXXXXXXXXXXXXXXXXXXXXXXXXXXXXXYXXEXXXXXXSRXXXXXXXRXXXXXXXXXXXXXRXHXXXKXXXXXXXXXXXXRXXXXGXXXXXXXX

SEQ ID NO: 27405 - protein, 704 aa, artificial
  consensus
  misc_feature (1)..(109): Xaa can be any naturally occurring amino acid
  misc_feature (113)..(114): Xaa can be any naturally occurring amino acid
  misc_feature (117)..(120): Xaa can be any naturally occurring amino acid
  misc_feature (123)..(123): Xaa can be any naturally occurring amino acid
  misc_feature (125)..(125): Xaa can be any naturally occurring amino acid
  misc_feature (127)..(128): Xaa can be any naturally occurring amino acid
  misc_feature (130)..(137): Xaa can be any naturally occurring amino acid
  misc_feature (139)..(144): Xaa can be any naturally occurring amino acid
  misc_feature (146)..(149): Xaa can be any naturally occurring amino acid
  misc_feature (151)..(152): Xaa can be any naturally occurring amino acid
  misc_feature (154)..(155): Xaa can be any naturally occurring amino acid
  misc_feature (159)..(166): Xaa can be any naturally occurring amino acid
  misc_feature (170)..(172): Xaa can be any naturally occurring amino acid
  misc_feature (174)..(174): Xaa can be any naturally occurring amino acid
  misc_feature (176)..(190): Xaa can be any naturally occurring amino acid
  misc_feature (192)..(193): Xaa can be any naturally occurring amino acid
  misc_feature (195)..(195): Xaa can be any naturally occurring amino acid
  misc_feature (201)..(201): Xaa can be any naturally occurring amino acid
  misc_feature (204)..(204): Xaa can be any naturally occurring amino acid
  misc_feature (206)..(206): Xaa can be any naturally occurring amino acid
  misc_feature (208)..(208): Xaa can be any naturally occurring amino acid
  misc_feature (210)..(211): Xaa can be any naturally occurring amino acid
  misc_feature (213)..(219): Xaa can be any naturally occurring amino acid
  misc_feature (221)..(228): Xaa can be any naturally occurring amino acid
  misc_feature (231)..(231): Xaa can be any naturally occurring amino acid
  misc_feature (233)..(237): Xaa can be any naturally occurring amino acid
  misc_feature (239)..(241): Xaa can be any naturally occurring amino acid
  misc_feature (243)..(243): Xaa can be any naturally occurring amino acid
  misc_feature (246)..(247): Xaa can be any naturally occurring amino acid
  misc_feature (249)..(251): Xaa can be any naturally occurring amino acid
  misc_feature (253)..(256): Xaa can be any naturally occurring amino acid
  misc_feature (258)..(277): Xaa can be any naturally occurring amino acid
  misc_feature (283)..(290): Xaa can be any naturally occurring amino acid
  misc_feature (292)..(292): Xaa can be any naturally occurring amino acid
  misc_feature (294)..(295): Xaa can be any naturally occurring amino acid
  misc_feature (297)..(325): Xaa can be any naturally occurring amino acid
  misc_feature (327)..(327): Xaa can be any naturally occurring amino acid
  misc_feature (334)..(334): Xaa can be any naturally occurring amino acid
  misc_feature (336)..(337): Xaa can be any naturally occurring amino acid
  misc_feature (340)..(341): Xaa can be any naturally occurring amino acid
  misc_feature (343)..(353): Xaa can be any naturally occurring amino acid
  misc_feature (359)..(360): Xaa can be any naturally occurring amino acid
  misc_feature (362)..(362): Xaa can be any naturally occurring amino acid
  misc_feature (365)..(366): Xaa can be any naturally occurring amino acid
  misc_feature (374)..(376): Xaa can be any naturally occurring amino acid
  misc_feature (378)..(378): Xaa can be any naturally occurring amino acid
  misc_feature (381)..(382): Xaa can be any naturally occurring amino acid
  misc_feature (385)..(388): Xaa can be any naturally occurring amino acid
  misc_feature (391)..(391): Xaa can be any naturally occurring amino acid
  misc_feature (394)..(394): Xaa can be any naturally occurring amino acid
  misc_feature (396)..(398): Xaa can be any naturally occurring amino acid
  misc_feature (401)..(401): Xaa can be any naturally occurring amino acid
  misc_feature (403)..(406): Xaa can be any naturally occurring amino acid
  misc_feature (408)..(410): Xaa can be any naturally occurring amino acid
  misc_feature (414)..(417): Xaa can be any naturally occurring amino acid
  misc_feature (419)..(421): Xaa can be any naturally occurring amino acid
  misc_feature (425)..(427): Xaa can be any naturally occurring amino acid
  misc_feature (429)..(429): Xaa can be any naturally occurring amino acid
  misc_feature (431)..(432): Xaa can be any naturally occurring amino acid
  misc_feature (435)..(444): Xaa can be any naturally occurring amino acid
  misc_feature (446)..(447): Xaa can be any naturally occurring amino acid
  misc_feature (449)..(460): Xaa can be any naturally occurring amino acid
  misc_feature (462)..(544): Xaa can be any naturally occurring amino acid
  misc_feature (546)..(546): Xaa can be any naturally occurring amino acid
  misc_feature (548)..(550): Xaa can be any naturally occurring amino acid
  misc_feature (552)..(572): Xaa can be any naturally occurring amino acid
  misc_feature (574)..(577): Xaa can be any naturally occurring amino acid
  misc_feature (580)..(581): Xaa can be any naturally occurring amino acid
  misc_feature (584)..(586): Xaa can be any naturally occurring amino acid
  misc_feature (588)..(599): Xaa can be any naturally occurring amino acid
  misc_feature (601)..(603): Xaa can be any naturally occurring amino acid
  misc_feature (605)..(612): Xaa can be any naturally occurring amino acid
  misc_feature (614)..(618): Xaa can be any naturally occurring amino acid
  misc_feature (620)..(626): Xaa can be any naturally occurring amino acid
  misc_feature (628)..(704): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDELXXDGXXXXNLXAXFXXTXXXXXXXXLXXXXXXKXXXXNXXDXXEYPXXXXXXXXRCVXXXAXLXXXXXXXXXXXXXXXGXXTXGSSEAXMLXGXAXKXXWXXXXXXXGXXXXXXXXPNXVXXXXXQXXXWXKFXXYXXXEXXXXVXXXXXXXXXXXXXXXXXXXXDENTIXXXXXXXXGXTXXGXXXXXXXXXXXXXXXXXXXXXXXXXXXXXHXDAASGGXFXXPFXXPXXXXXXXXXXXWDFRLXXVXSIXXSGHKYGLXXXGXGWXXWRXXXXLPXELXFXXXYLXGXXXXTXXXNFSXXXXQXXXQYYXXXRXGXXGYXXXXXXXXXXAXXLXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXPXVXXXLXXXXXXXXXXXXXXXXXXXXXLXXXXGWXXPAXXXPXXXXXXXXXXXXRXXXRXXXXXXXXAXXXXXDXXXXXXXLXXXXXXXXXXXXXXXXXXXXXXXXXXXXXXXXXXXXXXXXXXXXXXXXXXXXXXXXXXXXXXXXXXXXXXXXXXXXX

SEQ ID NO: 27406 - protein, 767 aa, artificial
  consensus
  misc_feature (1)..(141): Xaa can be any naturally occurring amino acid
  misc_feature (143)..(167): Xaa can be any naturally occurring amino acid
  misc_feature (169)..(203): Xaa can be any naturally occurring amino acid
  misc_feature (205)..(205): Xaa can be any naturally occurring amino acid
  misc_feature (207)..(210): Xaa can be any naturally occurring amino acid
  misc_feature (212)..(214): Xaa can be any naturally occurring amino acid
  misc_feature (217)..(226): Xaa can be any naturally occurring amino acid
  misc_feature (230)..(231): Xaa can be any naturally occurring amino acid
  misc_feature (233)..(236): Xaa can be any naturally occurring amino acid
  misc_feature (238)..(243): Xaa can be any naturally occurring amino acid
  misc_feature (245)..(250): Xaa can be any naturally occurring amino acid
  misc_feature (252)..(281): Xaa can be any naturally occurring amino acid
  misc_feature (284)..(284): Xaa can be any naturally occurring amino acid
  misc_feature (287)..(291): Xaa can be any naturally occurring amino acid
  misc_feature (293)..(298): Xaa can be any naturally occurring amino acid
  misc_feature (301)..(302): Xaa can be any naturally occurring amino acid
  misc_feature (306)..(308): Xaa can be any naturally occurring amino acid
  misc_feature (311)..(311): Xaa can be any naturally occurring amino acid
  misc_feature (313)..(314): Xaa can be any naturally occurring amino acid
  misc_feature (317)..(317): Xaa can be any naturally occurring amino acid
  misc_feature (319)..(363): Xaa can be any naturally occurring amino acid
  misc_feature (365)..(428): Xaa can be any naturally occurring amino acid
  misc_feature (433)..(434): Xaa can be any naturally occurring amino acid
  misc_feature (439)..(441): Xaa can be any naturally occurring amino acid
  misc_feature (443)..(446): Xaa can be any naturally occurring amino acid
  misc_feature (449)..(464): Xaa can be any naturally occurring amino acid
  misc_feature (466)..(466): Xaa can be any naturally occurring amino acid
  misc_feature (474)..(475): Xaa can be any naturally occurring amino acid
  misc_feature (477)..(495): Xaa can be any naturally occurring amino acid
  misc_feature (497)..(497): Xaa can be any naturally occurring amino acid
  misc_feature (508)..(508): Xaa can be any naturally occurring amino acid
  misc_feature (511)..(521): Xaa can be any naturally occurring amino acid
  misc_feature (526)..(526): Xaa can be any naturally occurring amino acid
  misc_feature (533)..(535): Xaa can be any naturally occurring amino acid
  misc_feature (540)..(541): Xaa can be any naturally occurring amino acid
  misc_feature (550)..(576): Xaa can be any naturally occurring amino acid
  misc_feature (579)..(579): Xaa can be any naturally occurring amino acid
  misc_feature (582)..(582): Xaa can be any naturally occurring amino acid
  misc_feature (589)..(589): Xaa can be any naturally occurring amino acid
  misc_feature (591)..(591): Xaa can be any naturally occurring amino acid
  misc_feature (594)..(596): Xaa can be any naturally occurring amino acid
  misc_feature (599)..(600): Xaa can be any naturally occurring amino acid
  misc_feature (602)..(603): Xaa can be any naturally occurring amino acid
  misc_feature (606)..(606): Xaa can be any naturally occurring amino acid
  misc_feature (608)..(608): Xaa can be any naturally occurring amino acid
  misc_feature (610)..(611): Xaa can be any naturally occurring amino acid
  misc_feature (613)..(615): Xaa can be any naturally occurring amino acid
  misc_feature (617)..(619): Xaa can be any naturally occurring amino acid
  misc_feature (621)..(623): Xaa can be any naturally occurring amino acid
  misc_feature (626)..(626): Xaa can be any naturally occurring amino acid
  misc_feature (628)..(628): Xaa can be any naturally occurring amino acid
  misc_feature (634)..(635): Xaa can be any naturally occurring amino acid
  misc_feature (641)..(641): Xaa can be any naturally occurring amino acid
  misc_feature (645)..(645): Xaa can be any naturally occurring amino acid
  misc_feature (652)..(666): Xaa can be any naturally occurring amino acid
  misc_feature (668)..(711): Xaa can be any naturally occurring amino acid
  misc_feature (713)..(715): Xaa can be any naturally occurring amino acid
  misc_feature (722)..(723): Xaa can be any naturally occurring amino acid
  misc_feature (725)..(732): Xaa can be any naturally occurring amino acid
  misc_feature (734)..(738): Xaa can be any naturally occurring amino acid
  misc_feature (740)..(748): Xaa can be any naturally occurring amino acid
  misc_feature (752)..(752): Xaa can be any naturally occurring amino acid
  misc_feature (755)..(759): Xaa can be any naturally occurring amino acid
  misc_feature (761)..(761): Xaa can be any naturally occurring amino acid
  misc_feature (766)..(767): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXEXXXXXXXXXXXXXXXXXXXXXXXXXXXXXXXXXXXYXAXXXXYXXXWSXXXXXXXXXXRLAXXSXXXXEXXXXXXNXXXXXXLXXXXXXXXXXXXXXXXXXXXXXXXXXXXXXYPXTKXXXXXPXXXXXXPDXXLLAXXXTSXDXXLRXWXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXPLTSXXFDWNXXXPXXXXTSXXXXXXXXXXXXXXXXSXDTTCTIWXXEXXXXXXXXXXXXXXXXXXXVXTQLIAHDKEVXDIXXXXXXXXXXXFASVXADGSVRXXXFDLRXXEHSTIIYEXXXXXXXXXXXXXXXXXXXXXXXXXXXPLXRLXWNKQDPXYXATXXXDSXXVXXLDXRXPXXPXXXLXXXHXXXVNXIXWAPHSXXHICTAXGDDXQALIWDXXXXXXXXXXXXXXXMXXXXXXXXXXXXXXXXXXXXXXXXXXXXXXXXXXXXXXXXXXXXEXXXDPILAYXXAXXXXXXXXEXXXXXWXXXXXXXXXPDWXAIXXXXXLXILRVXX

SEQ ID NO: 27407 - protein, 603 aa, artificial
  consensus
  misc_feature (1)..(89): Xaa can be any naturally occurring amino acid
  misc_feature (91)..(127): Xaa can be any naturally occurring amino acid
  misc_feature (129)..(133): Xaa can be any naturally occurring amino acid
  misc_feature (135)..(167): Xaa can be any naturally occurring amino acid
  misc_feature (169)..(169): Xaa can be any naturally occurring amino acid
  misc_feature (171)..(178): Xaa can be any naturally occurring amino acid
  misc_feature (183)..(185): Xaa can be any naturally occurring amino acid
  misc_feature (187)..(188): Xaa can be any naturally occurring amino acid
  misc_feature (190)..(191): Xaa can be any naturally occurring amino acid
  misc_feature (193)..(198): Xaa can be any naturally occurring amino acid
  misc_feature (200)..(209): Xaa can be any naturally occurring amino acid
  misc_feature (211)..(212): Xaa can be any naturally occurring amino acid
  misc_feature (214)..(220): Xaa can be any naturally occurring amino acid
  misc_feature (222)..(225): Xaa can be any naturally occurring amino acid
  misc_feature (227)..(238): Xaa can be any naturally occurring amino acid
  misc_feature (240)..(246): Xaa can be any naturally occurring amino acid
  misc_feature (248)..(248): Xaa can be any naturally occurring amino acid
  misc_feature (250)..(252): Xaa can be any naturally occurring amino acid
  misc_feature (254)..(254): Xaa can be any naturally occurring amino acid
  misc_feature (256)..(260): Xaa can be any naturally occurring amino acid
  misc_feature (262)..(281): Xaa can be any naturally occurring amino acid
  misc_feature (285)..(291): Xaa can be any naturally occurring amino acid
  misc_feature (293)..(300): Xaa can be any naturally occurring amino acid
  misc_feature (302)..(303): Xaa can be any naturally occurring amino acid
  misc_feature (307)..(320): Xaa can be any naturally occurring amino acid
  misc_feature (322)..(332): Xaa can be any naturally occurring amino acid
  misc_feature (334)..(335): Xaa can be any naturally occurring amino acid
  misc_feature (338)..(345): Xaa can be any naturally occurring amino acid
  misc_feature (347)..(347): Xaa can be any naturally occurring amino acid
  misc_feature (349)..(350): Xaa can be any naturally occurring amino acid
  misc_feature (352)..(373): Xaa can be any naturally occurring amino acid
  misc_feature (376)..(385): Xaa can be any naturally occurring amino acid
  misc_feature (387)..(392): Xaa can be any naturally occurring amino acid
  misc_feature (394)..(394): Xaa can be any naturally occurring amino acid
  misc_feature (396)..(399): Xaa can be any naturally occurring amino acid
  misc_feature (401)..(407): Xaa can be any naturally occurring amino acid
  misc_feature (409)..(411): Xaa can be any naturally occurring amino acid
  misc_feature (413)..(415): Xaa can be any naturally occurring amino acid
  misc_feature (420)..(421): Xaa can be any naturally occurring amino acid
  misc_feature (426)..(428): Xaa can be any naturally occurring amino acid
  misc_feature (430)..(431): Xaa can be any naturally occurring amino acid
  misc_feature (433)..(433): Xaa can be any naturally occurring amino acid
  misc_feature (435)..(435): Xaa can be any naturally occurring amino acid
  misc_feature (437)..(453): Xaa can be any naturally occurring amino acid
  misc_feature (456)..(457): Xaa can be any naturally occurring amino acid
  misc_feature (459)..(473): Xaa can be any naturally occurring amino acid
  misc_feature (475)..(479): Xaa can be any naturally occurring amino acid
  misc_feature (481)..(486): Xaa can be any naturally occurring amino acid
  misc_feature (488)..(492): Xaa can be any naturally occurring amino acid
  misc_feature (494)..(508): Xaa can be any naturally occurring amino acid
  misc_feature (514)..(529): Xaa can be any naturally occurring amino acid
  misc_feature (535)..(538): Xaa can be any naturally occurring amino acid
  misc_feature (540)..(540): Xaa can be any naturally occurring amino acid
  misc_feature (543)..(545): Xaa can be any naturally occurring amino acid
  misc_feature (547)..(548): Xaa can be any naturally occurring amino acid
  misc_feature (551)..(554): Xaa can be any naturally occurring amino acid
  misc_feature (556)..(603): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXXXXXXXXXXXPXXXXXGXXXXXXXXXXXXXXXXXXXXXXXXXXXXXXXXXGXPXXXXXXXXDTGSXXXWXXCXXPXXXXXXCXXXXXXXXXXPXXSXXXXXXXCXXXXCXXXXXXXXXXXXCXXXXXXXCXYXXXYXDXXXXXGXXXXXXXXXXXXXXXXXXXXFGCXXXXXXXGXXXXXXXXGXXGLGXXXXXXXXXXXXXXQXXXXXXXXXXXFXXCLXXXXXXXXGXLXXGXXXXXXXXXXXXXXXXXXXXXXTPXXXXXXXXXXYXXXXXXIXVXXXXLXXXXXXXFXXXGXXXDSGTXXTRLPXXXYXXLXSXFXXXXXXXXXXXXXXXXXDTXXCXXXXXXXXXXXXXXXPXXXXXFXXXXXXGXXXXXLXXXXXXXXXXXXXXXCLAFAXXXXXXXXXXXXXXXXGNVQQXXXXVXYDXXXGXXGFXXXXCXXXXXXXXXXXXXXXXXXXXXXXXXXXXXXXXXXXXXXXXXXXXXXXX

SEQ ID NO: 27408 - protein, 700 aa, artificial
  consensus
  misc_feature (1)..(177): Xaa can be any naturally occurring amino acid
  misc_feature (181)..(181): Xaa can be any naturally occurring amino acid
  misc_feature (183)..(238): Xaa can be any naturally occurring amino acid
  misc_feature (241)..(241): Xaa can be any naturally occurring amino acid
  misc_feature (243)..(243): Xaa can be any naturally occurring amino acid
  misc_feature (246)..(274): Xaa can be any naturally occurring amino acid
  misc_feature (280)..(281): Xaa can be any naturally occurring amino acid
  misc_feature (283)..(287): Xaa can be any naturally occurring amino acid
  misc_feature (289)..(313): Xaa can be any naturally occurring amino acid
  misc_feature (315)..(450): Xaa can be any naturally occurring amino acid
  misc_feature (453)..(453): Xaa can be any naturally occurring amino acid
  misc_feature (455)..(457): Xaa can be any naturally occurring amino acid
  misc_feature (459)..(462): Xaa can be any naturally occurring amino acid
  misc_feature (464)..(465): Xaa can be any naturally occurring amino acid
  misc_feature (467)..(540): Xaa can be any naturally occurring amino acid
  misc_feature (542)..(548): Xaa can be any naturally occurring amino acid
  misc_feature (550)..(562): Xaa can be any naturally occurring amino acid
  misc_feature (564)..(568): Xaa can be any naturally occurring amino acid
  misc_feature (570)..(571): Xaa can be any naturally occurring amino acid
  misc_feature (573)..(574): Xaa can be any naturally occurring amino acid
  misc_feature (576)..(584): Xaa can be any naturally occurring amino acid
  misc_feature (588)..(597): Xaa can be any naturally occurring amino acid
  misc_feature (600)..(602): Xaa can be any naturally occurring amino acid
  misc_feature (604)..(606): Xaa can be any naturally occurring amino acid
  misc_feature (608)..(614): Xaa can be any naturally occurring amino acid
  misc_feature (616)..(617): Xaa can be any naturally occurring amino acid
  misc_feature (619)..(619): Xaa can be any naturally occurring amino acid
  misc_feature (621)..(622): Xaa can be any naturally occurring amino acid
  misc_feature (624)..(624): Xaa can be any naturally occurring amino acid
  misc_feature (626)..(700): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMASXQXXXXXXXXXXXXXXXXXXXXXXXXXXXXXXXXXXXXXXXXXXXXXXXXXXXXXXXXSYXAXGEXXXXXXXXXXXXXXXXXXXXXXXXXXXXXEKTGQXXGXXXXXAXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAKXKXXXTXXXXKXXAXXXXXXXXXXXXXXXXXXXXXXXXXXXXXXXXXXXXXXXXXXXXXXXXXXXXXXXXXXXXXXXXXXXXXXXXXXKXXXXXXXAXXXXXXXXXXXXXKXXXXXQXXKXXAXXXXXXXXXGKDXXXXXXXXXXQQXXXEXXXVXXXXXXXAXXAXVXXTXGXXXXXXXXXXXXXXXXXXXXXXXXXXXXXXXXXXXXXXXXXXXXXXXXXXXXXXXXXXXXXXXXXXXXXXXXXXX

SEQ ID NO: 27409 - protein, 866 aa, artificial
  consensus
  misc_feature (1)..(142): Xaa can be any naturally occurring amino acid
  misc_feature (144)..(150): Xaa can be any naturally occurring amino acid
  misc_feature (153)..(154): Xaa can be any naturally occurring amino acid
  misc_feature (157)..(158): Xaa can be any naturally occurring amino acid
  misc_feature (161)..(161): Xaa can be any naturally occurring amino acid
  misc_feature (165)..(167): Xaa can be any naturally occurring amino acid
  misc_feature (177)..(177): Xaa can be any naturally occurring amino acid
  misc_feature (179)..(180): Xaa can be any naturally occurring amino acid
  misc_feature (182)..(198): Xaa can be any naturally occurring amino acid
  misc_feature (200)..(200): Xaa can be any naturally occurring amino acid
  misc_feature (202)..(203): Xaa can be any naturally occurring amino acid
  misc_feature (206)..(207): Xaa can be any naturally occurring amino acid
  misc_feature (209)..(214): Xaa can be any naturally occurring amino acid
  misc_feature (216)..(222): Xaa can be any naturally occurring amino acid
  misc_feature (227)..(228): Xaa can be any naturally occurring amino acid
  misc_feature (238)..(272): Xaa can be any naturally occurring amino acid
  misc_feature (282)..(283): Xaa can be any naturally occurring amino acid
  misc_feature (285)..(286): Xaa can be any naturally occurring amino acid
  misc_feature (288)..(305): Xaa can be any naturally occurring amino acid
  misc_feature (307)..(307): Xaa can be any naturally occurring amino acid
  misc_feature (314)..(315): Xaa can be any naturally occurring amino acid
  misc_feature (320)..(320): Xaa can be any naturally occurring amino acid
  misc_feature (322)..(322): Xaa can be any naturally occurring amino acid
  misc_feature (325)..(326): Xaa can be any naturally occurring amino acid
  misc_feature (330)..(331): Xaa can be any naturally occurring amino acid
  misc_feature (334)..(334): Xaa can be any naturally occurring amino acid
  misc_feature (341)..(341): Xaa can be any naturally occurring amino acid
  misc_feature (343)..(350): Xaa can be any naturally occurring amino acid
  misc_feature (352)..(360): Xaa can be any naturally occurring amino acid
  misc_feature (362)..(362): Xaa can be any naturally occurring amino acid
  misc_feature (364)..(364): Xaa can be any naturally occurring amino acid
  misc_feature (367)..(367): Xaa can be any naturally occurring amino acid
  misc_feature (369)..(371): Xaa can be any naturally occurring amino acid
  misc_feature (373)..(377): Xaa can be any naturally occurring amino acid
  misc_feature (380)..(382): Xaa can be any naturally occurring amino acid
  misc_feature (386)..(387): Xaa can be any naturally occurring amino acid
  misc_feature (390)..(392): Xaa can be any naturally occurring amino acid
  misc_feature (394)..(395): Xaa can be any naturally occurring amino acid
  misc_feature (398)..(399): Xaa can be any naturally occurring amino acid
  misc_feature (402)..(403): Xaa can be any naturally occurring amino acid
  misc_feature (407)..(407): Xaa can be any naturally occurring amino acid
  misc_feature (410)..(411): Xaa can be any naturally occurring amino acid
  misc_feature (413)..(470): Xaa can be any naturally occurring amino acid
  misc_feature (472)..(473): Xaa can be any naturally occurring amino acid
  misc_feature (476)..(477): Xaa can be any naturally occurring amino acid
  misc_feature (479)..(479): Xaa can be any naturally occurring amino acid
  misc_feature (482)..(482): Xaa can be any naturally occurring amino acid
  misc_feature (492)..(504): Xaa can be any naturally occurring amino acid
  misc_feature (506)..(514): Xaa can be any naturally occurring amino acid
  misc_feature (516)..(518): Xaa can be any naturally occurring amino acid
  misc_feature (521)..(525): Xaa can be any naturally occurring amino acid
  misc_feature (527)..(554): Xaa can be any naturally occurring amino acid
  misc_feature (556)..(572): Xaa can be any naturally occurring amino acid
  misc_feature (574)..(649): Xaa can be any naturally occurring amino acid
  misc_feature (651)..(653): Xaa can be any naturally occurring amino acid
  misc_feature (656)..(656): Xaa can be any naturally occurring amino acid
  misc_feature (659)..(660): Xaa can be any naturally occurring amino acid
  misc_feature (663)..(866): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXXXXXXDFXXGGXXAAXSKTXXXAPIERVKLLXQXXQXXXXXXXXXXXXXXXXXYXGXXDCXXRXXXXXXGXXXXXXXWRGNXXANVIRYFPTXXXXXXXXXXXXXXXXXXXXXXXXXXXXXXXXXXXQALNFAFKDXXKXXFXXXXXXXXXXXXXXXXXXFXGNLASGXXGAAGXAXSLXXFVYXXLDXARTRLAXDXXXXXXXXKXXXXXXXXXRXFXGLXDXXXKXXXXXDGXXXGLYXXGFXXXSXXGIXXYRXXYFGXYDXXKXXXXXXXXXXXXXXXXXXXXXXXXXXXXXXXXXXXXXXXXXXXXXXXXXXXXXXXXXXTXXAGXXSXYPXDTVRRRMMMXXXXXXXXXXXXXYXXXXXXXXXIXXXEGXXXXXFXXXXXXXXXXXXXXXXXXXXXXXXXXXXGXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXRXXXGAXVLXXYDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27410 - protein, 237 aa, artificial
  consensus
  misc_feature (1)..(15): Xaa can be any naturally occurring amino acid
  misc_feature (17)..(23): Xaa can be any naturally occurring amino acid
  misc_feature (25)..(33): Xaa can be any naturally occurring amino acid
  misc_feature (35)..(36): Xaa can be any naturally occurring amino acid
  misc_feature (44)..(45): Xaa can be any naturally occurring amino acid
  misc_feature (47)..(56): Xaa can be any naturally occurring amino acid
  misc_feature (58)..(65): Xaa can be any naturally occurring amino acid
  misc_feature (70)..(71): Xaa can be any naturally occurring amino acid
  misc_feature (80)..(81): Xaa can be any naturally occurring amino acid
  misc_feature (83)..(84): Xaa can be any naturally occurring amino acid
  misc_feature (88)..(88): Xaa can be any naturally occurring amino acid
  misc_feature (90)..(90): Xaa can be any naturally occurring amino acid
  misc_feature (93)..(108): Xaa can be any naturally occurring amino acid
  misc_feature (110)..(111): Xaa can be any naturally occurring amino acid
  misc_feature (113)..(117): Xaa can be any naturally occurring amino acid
  misc_feature (119)..(119): Xaa can be any naturally occurring amino acid
  misc_feature (121)..(124): Xaa can be any naturally occurring amino acid
  misc_feature (126)..(127): Xaa can be any naturally occurring amino acid
  misc_feature (129)..(129): Xaa can be any naturally occurring amino acid
  misc_feature (135)..(135): Xaa can be any naturally occurring amino acid
  misc_feature (144)..(144): Xaa can be any naturally occurring amino acid
  misc_feature (148)..(148): Xaa can be any naturally occurring amino acid
  misc_feature (150)..(169): Xaa can be any naturally occurring amino acid
  misc_feature (171)..(177): Xaa can be any naturally occurring amino acid
  misc_feature (179)..(180): Xaa can be any naturally occurring amino acid
  misc_feature (182)..(183): Xaa can be any naturally occurring amino acid
  misc_feature (186)..(186): Xaa can be any naturally occurring amino acid
  misc_feature (191)..(196): Xaa can be any naturally occurring amino acid
  misc_feature (199)..(200): Xaa can be any naturally occurring amino acid
  misc_feature (203)..(217): Xaa can be any naturally occurring amino acid
  misc_feature (219)..(219): Xaa can be any naturally occurring amino acid
  misc_feature (221)..(237): Xaa can be any naturally occurring amino acid
XXXXXXXXXXXXXXXPXXXXXXXYXXXXXXXXXGXXLTPTQVKXXPXXXXXXXXXXWXXXXXXXXLYTLXXTDPDAPSRXXPXXREWXHXLVXXXXXXXXXXXXXXXXNXXGXXXXXSXGXXXXLXXYXGSGPPXGTGLHRYVXLVYXQXXXXXXXXXXXXXXXXXXXXRXXXXXXXFXXKXXLGXPVAGXXXXXXQAXXDDXXXXXXXXXXXXXXXYXPXXXXXXXXXXXXXXXXX

SEQ ID NO: 27411 - protein, 261 aa, artificial
  consensus
  misc_feature (1)..(34): Xaa can be any naturally occurring amino acid
  misc_feature (36)..(42): Xaa can be any naturally occurring amino acid
  misc_feature (44)..(44): Xaa can be any naturally occurring amino acid
  misc_feature (46)..(54): Xaa can be any naturally occurring amino acid
  misc_feature (56)..(57): Xaa can be any naturally occurring amino acid
  misc_feature (65)..(66): Xaa can be any naturally occurring amino acid
  misc_feature (68)..(71): Xaa can be any naturally occurring amino acid
  misc_feature (73)..(88): Xaa can be any naturally occurring amino acid
  misc_feature (92)..(94): Xaa can be any naturally occurring amino acid
  misc_feature (102)..(103): Xaa can be any naturally occurring amino acid
  misc_feature (105)..(106): Xaa can be any naturally occurring amino acid
  misc_feature (109)..(110): Xaa can be any naturally occurring amino acid
  misc_feature (112)..(112): Xaa can be any naturally occurring amino acid
  misc_feature (115)..(130): Xaa can be any naturally occurring amino acid
  misc_feature (132)..(133): Xaa can be any naturally occurring amino acid
  misc_feature (135)..(141): Xaa can be any naturally occurring amino acid
  misc_feature (143)..(146): Xaa can be any naturally occurring amino acid
  misc_feature (148)..(149): Xaa can be any naturally occurring amino acid
  misc_feature (151)..(151): Xaa can be any naturally occurring amino acid
  misc_feature (153)..(153): Xaa can be any naturally occurring amino acid
  misc_feature (157)..(157): Xaa can be any naturally occurring amino acid
  misc_feature (166)..(166): Xaa can be any naturally occurring amino acid
  misc_feature (168)..(168): Xaa can be any naturally occurring amino acid
  misc_feature (170)..(170): Xaa can be any naturally occurring amino acid
  misc_feature (172)..(180): Xaa can be any naturally occurring amino acid
  misc_feature (182)..(187): Xaa can be any naturally occurring amino acid
  misc_feature (189)..(191): Xaa can be any naturally occurring amino acid
  misc_feature (193)..(199): Xaa can be any naturally occurring amino acid
  misc_feature (201)..(207): Xaa can be any naturally occurring amino acid
  misc_feature (210)..(210): Xaa can be any naturally occurring amino acid
  misc_feature (212)..(212): Xaa can be any naturally occurring amino acid
  misc_feature (215)..(220): Xaa can be any naturally occurring amino acid
  misc_feature (223)..(224): Xaa can be any naturally occurring amino acid
  misc_feature (227)..(241): Xaa can be any naturally occurring amino acid
  misc_feature (245)..(245): Xaa can be any naturally occurring amino acid
  misc_feature (247)..(261): Xaa can be any naturally occurring amino acid
XXXXXXXXXXXXXXXXXXXXXXXXXXXXXXXXXXPXXXXXXXVXYXXXXXXXXXGXXLTPTQVKXXPXXXXWXXXXXXXXXXXXXXXXYTLXXXDPDAPSRXXPXXREXXHXLVXXXXXXXXXXXXXXXXNXXGXXXXXXXGXXXXLXXYXGXGPPXGTGLHRYVXLXYXQXXXXXXXXXEXXXXXXSXXXRXXXXXXXFXXXXXXXLGXPXAGXXXXXXQAXXDDXXXXXXXXXXXXXXXYVPXLXXXXXXXXXXXXXXX

SEQ ID NO: 27412 - protein, 576 aa, artificial
  consensus
  misc_feature (1)..(224): Xaa can be any naturally occurring amino acid
  misc_feature (228)..(229): Xaa can be any naturally occurring amino acid
  misc_feature (233)..(234): Xaa can be any naturally occurring amino acid
  misc_feature (237)..(250): Xaa can be any naturally occurring amino acid
  misc_feature (252)..(253): Xaa can be any naturally occurring amino acid
  misc_feature (255)..(255): Xaa can be any naturally occurring amino acid
  misc_feature (257)..(263): Xaa can be any naturally occurring amino acid
  misc_feature (265)..(269): Xaa can be any naturally occurring amino acid
  misc_feature (271)..(272): Xaa can be any naturally occurring amino acid
  misc_feature (276)..(278): Xaa can be any naturally occurring amino acid
  misc_feature (280)..(281): Xaa can be any naturally occurring amino acid
  misc_feature (283)..(284): Xaa can be any naturally occurring amino acid
  misc_feature (286)..(290): Xaa can be any naturally occurring amino acid
  misc_feature (292)..(292): Xaa can be any naturally occurring amino acid
  misc_feature (295)..(296): Xaa can be any naturally occurring amino acid
  misc_feature (299)..(302): Xaa can be any naturally occurring amino acid
  misc_feature (304)..(305): Xaa can be any naturally occurring amino acid
  misc_feature (307)..(334): Xaa can be any naturally occurring amino acid
  misc_feature (336)..(576): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKDPXXPKRXXSAXXXXXXXXXXXXXXFXXEXRXXXXXXXPXXXXXVXXVGKXXXGXXWXXLXXXXXKXPYXXKAXXXXKXXYXXXXXXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27413 - protein, 766 aa, artificial
  consensus
  misc_feature (1)..(178): Xaa can be any naturally occurring amino acid
  misc_feature (180)..(188): Xaa can be any naturally occurring amino acid
  misc_feature (190)..(191): Xaa can be any naturally occurring amino acid
  misc_feature (194)..(204): Xaa can be any naturally occurring amino acid
  misc_feature (206)..(208): Xaa can be any naturally occurring amino acid
  misc_feature (210)..(210): Xaa can be any naturally occurring amino acid
  misc_feature (212)..(216): Xaa can be any naturally occurring amino acid
  misc_feature (218)..(225): Xaa can be any naturally occurring amino acid
  misc_feature (227)..(227): Xaa can be any naturally occurring amino acid
  misc_feature (229)..(238): Xaa can be any naturally occurring amino acid
  misc_feature (240)..(245): Xaa can be any naturally occurring amino acid
  misc_feature (247)..(249): Xaa can be any naturally occurring amino acid
  misc_feature (251)..(252): Xaa can be any naturally occurring amino acid
  misc_feature (254)..(258): Xaa can be any naturally occurring amino acid
  misc_feature (260)..(264): Xaa can be any naturally occurring amino acid
  misc_feature (266)..(297): Xaa can be any naturally occurring amino acid
  misc_feature (299)..(303): Xaa can be any naturally occurring amino acid
  misc_feature (305)..(307): Xaa can be any naturally occurring amino acid
  misc_feature (311)..(318): Xaa can be any naturally occurring amino acid
  misc_feature (321)..(322): Xaa can be any naturally occurring amino acid
  misc_feature (325)..(334): Xaa can be any naturally occurring amino acid
  misc_feature (337)..(448): Xaa can be any naturally occurring amino acid
  misc_feature (450)..(455): Xaa can be any naturally occurring amino acid
  misc_feature (457)..(457): Xaa can be any naturally occurring amino acid
  misc_feature (459)..(469): Xaa can be any naturally occurring amino acid
  misc_feature (472)..(473): Xaa can be any naturally occurring amino acid
  misc_feature (477)..(477): Xaa can be any naturally occurring amino acid
  misc_feature (479)..(480): Xaa can be any naturally occurring amino acid
  misc_feature (483)..(514): Xaa can be any naturally occurring amino acid
  misc_feature (516)..(538): Xaa can be any naturally occurring amino acid
  misc_feature (540)..(542): Xaa can be any naturally occurring amino acid
  misc_feature (544)..(546): Xaa can be any naturally occurring amino acid
  misc_feature (548)..(552): Xaa can be any naturally occurring amino acid
  misc_feature (555)..(556): Xaa can be any naturally occurring amino acid
  misc_feature (559)..(562): Xaa can be any naturally occurring amino acid
  misc_feature (564)..(585): Xaa can be any naturally occurring amino acid
  misc_feature (588)..(594): Xaa can be any naturally occurring amino acid
  misc_feature (596)..(597): Xaa can be any naturally occurring amino acid
  misc_feature (600)..(602): Xaa can be any naturally occurring amino acid
  misc_feature (604)..(605): Xaa can be any naturally occurring amino acid
  misc_feature (608)..(611): Xaa can be any naturally occurring amino acid
  misc_feature (614)..(615): Xaa can be any naturally occurring amino acid
  misc_feature (619)..(619): Xaa can be any naturally occurring amino acid
  misc_feature (624)..(630): Xaa can be any naturally occurring amino acid
  misc_feature (636)..(637): Xaa can be any naturally occurring amino acid
  misc_feature (639)..(643): Xaa can be any naturally occurring amino acid
  misc_feature (647)..(651): Xaa can be any naturally occurring amino acid
  misc_feature (653)..(682): Xaa can be any naturally occurring amino acid
  misc_feature (684)..(689): Xaa can be any naturally occurring amino acid
  misc_feature (691)..(766): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXRXXKDXXXXXXXXXXXEXXXFXKXXXXXPXXXXXXXXYXKXXXXXXXXXXFXXXXXXFXXXFXXFXXXXXPXXXXXHXXXXXXXXXXXXXXXXXXXXXXXXXXXXXXXXWXXXXXYXXXELWXXXXXXXXFWXXANXXXXXXXXXXFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXXXXSXYXXXXXXXXXXXYGXXINLXEXXWKXXXXXXXXXXXXXXXXXXXXXXXXXXXXXXXXGXXXXXXXXXXXXXXXXXXXXXXXWXXXAXXXPXXXXXTGXXFFXXXXFXXXXXXXXXXXXXXXXXXXXXXPLXXXXXXXGXXQNXXXKXXKYXXXXFDXXKEMXYIPLXXXXXXXKGKAAXXVXXXXXGKSXXXXXQXXXXXXXXXXXXXXXXXXXXXXXXXXXXXXWXXXXXXLXXXXXXXXXXXXXXXXXXXXXXXXXXXXXXXXXXXXXXXXXXXXXXXXXXXXXXXXXXXXXXXXXXXXXXXXXXXX

SEQ ID NO: 27414 - protein, 323 aa, artificial
  consensus
  misc_feature (2)..(3): Xaa can be any naturally occurring amino acid
  misc_feature (5)..(9): Xaa can be any naturally occurring amino acid
  misc_feature (12)..(17): Xaa can be any naturally occurring amino acid
  misc_feature (20)..(25): Xaa can be any naturally occurring amino acid
  misc_feature (27)..(29): Xaa can be any naturally occurring amino acid
  misc_feature (32)..(34): Xaa can be any naturally occurring amino acid
  misc_feature (37)..(42): Xaa can be any naturally occurring amino acid
  misc_feature (44)..(45): Xaa can be any naturally occurring amino acid
  misc_feature (47)..(77): Xaa can be any naturally occurring amino acid
  misc_feature (80)..(80): Xaa can be any naturally occurring amino acid
  misc_feature (85)..(87): Xaa can be any naturally occurring amino acid
  misc_feature (89)..(89): Xaa can be any naturally occurring amino acid
  misc_feature (91)..(135): Xaa can be any naturally occurring amino acid
  misc_feature (138)..(138): Xaa can be any naturally occurring amino acid
  misc_feature (141)..(146): Xaa can be any naturally occurring amino acid
  misc_feature (148)..(149): Xaa can be any naturally occurring amino acid
  misc_feature (152)..(154): Xaa can be any naturally occurring amino acid
  misc_feature (159)..(159): Xaa can be any naturally occurring amino acid
  misc_feature (161)..(161): Xaa can be any naturally occurring amino acid
  misc_feature (164)..(164): Xaa can be any naturally occurring amino acid
  misc_feature (168)..(196): Xaa can be any naturally occurring amino acid
  misc_feature (198)..(200): Xaa can be any naturally occurring amino acid
  misc_feature (202)..(204): Xaa can be any naturally occurring amino acid
  misc_feature (206)..(216): Xaa can be any naturally occurring amino acid
  misc_feature (218)..(219): Xaa can be any naturally occurring amino acid
  misc_feature (221)..(241): Xaa can be any naturally occurring amino acid
  misc_feature (243)..(323): Xaa can be any naturally occurring amino acid
RXXNXXXXXQIXXXXXXGDXXXXXXAXXXELXXXYGXXXXXXNXXAXXXXXXXXXXXXXXXXXXXXXXXXXXXXXXXAYXTGLLXXXRXLXXXXXXXXXXXXXXXXXXXXXXXXXXXXXXXXXXXXXXXXXXXXXLDXGLXXXXXXGXXVFXXXLKGAXDXGLXIPHXXXXXXXXXXXXXXXXXXXXXXXXXXXXXHXXXYXXXLXXXXXXXXXXXFXXYXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27415 - protein, 854 aa, artificial
  consensus
  misc_feature (1)..(1): Xaa can be any naturally occurring amino acid
  misc_feature (4)..(6): Xaa can be any naturally occurring amino acid
  misc_feature (12)..(12): Xaa can be any naturally occurring amino acid
  misc_feature (16)..(16): Xaa can be any naturally occurring amino acid
  misc_feature (23)..(23): Xaa can be any naturally occurring amino acid
  misc_feature (37)..(37): Xaa can be any naturally occurring amino acid
  misc_feature (40)..(41): Xaa can be any naturally occurring amino acid
  misc_feature (43)..(301): Xaa can be any naturally occurring amino acid
  misc_feature (304)..(304): Xaa can be any naturally occurring amino acid
  misc_feature (306)..(318): Xaa can be any naturally occurring amino acid
  misc_feature (321)..(450): Xaa can be any naturally occurring amino acid
  misc_feature (452)..(557): Xaa can be any naturally occurring amino acid
  misc_feature (559)..(571): Xaa can be any naturally occurring amino acid
  misc_feature (573)..(580): Xaa can be any naturally occurring amino acid
  misc_feature (582)..(591): Xaa can be any naturally occurring amino acid
  misc_feature (593)..(593): Xaa can be any naturally occurring amino acid
  misc_feature (595)..(595): Xaa can be any naturally occurring amino acid
  misc_feature (597)..(598): Xaa can be any naturally occurring amino acid
  misc_feature (600)..(602): Xaa can be any naturally occurring amino acid
  misc_feature (605)..(606): Xaa can be any naturally occurring amino acid
  misc_feature (609)..(610): Xaa can be any naturally occurring amino acid
  misc_feature (612)..(618): Xaa can be any naturally occurring amino acid
  misc_feature (620)..(621): Xaa can be any naturally occurring amino acid
  misc_feature (623)..(675): Xaa can be any naturally occurring amino acid
  misc_feature (677)..(678): Xaa can be any naturally occurring amino acid
  misc_feature (680)..(694): Xaa can be any naturally occurring amino acid
  misc_feature (696)..(697): Xaa can be any naturally occurring amino acid
  misc_feature (699)..(854): Xaa can be any naturally occurring amino acid
XENXXXRQVTFXKRRXGLLKKAXELSVLCDAEVALIXFSXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLXEXXXXXXXXXXXXXRYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXXXXLXXXXXXXXRXXXXXXXXXXGXEXLXXLXXXELXXLEXXLXXXXXXXRXXKXXXXXXXXXXXXXXXXXXXXXXXXXXXXXXXXXXXXXXXXXXXXXXXXXXXXXEXXLXXXXXXXXXXXXXXXNXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27416 - protein, 1339 aa, artificial
  consensus
  misc_feature (1)..(237): Xaa can be any naturally occurring amino acid
  misc_feature (239)..(290): Xaa can be any naturally occurring amino acid
  misc_feature (293)..(312): Xaa can be any naturally occurring amino acid
  misc_feature (314)..(374): Xaa can be any naturally occurring amino acid
  misc_feature (376)..(380): Xaa can be any naturally occurring amino acid
  misc_feature (382)..(382): Xaa can be any naturally occurring amino acid
  misc_feature (384)..(405): Xaa can be any naturally occurring amino acid
  misc_feature (408)..(408): Xaa can be any naturally occurring amino acid
  misc_feature (410)..(410): Xaa can be any naturally occurring amino acid
  misc_feature (414)..(416): Xaa can be any naturally occurring amino acid
  misc_feature (418)..(450): Xaa can be any naturally occurring amino acid
  misc_feature (452)..(458): Xaa can be any naturally occurring amino acid
  misc_feature (460)..(462): Xaa can be any naturally occurring amino acid
  misc_feature (464)..(504): Xaa can be any naturally occurring amino acid
  misc_feature (506)..(507): Xaa can be any naturally occurring amino acid
  misc_feature (510)..(514): Xaa can be any naturally occurring amino acid
  misc_feature (517)..(523): Xaa can be any naturally occurring amino acid
  misc_feature (525)..(564): Xaa can be any naturally occurring amino acid
  misc_feature (566)..(568): Xaa can be any naturally occurring amino acid
  misc_feature (570)..(608): Xaa can be any naturally occurring amino acid
  misc_feature (610)..(666): Xaa can be any naturally occurring amino acid
  misc_feature (668)..(669): Xaa can be any naturally occurring amino acid
  misc_feature (672)..(675): Xaa can be any naturally occurring amino acid
  misc_feature (677)..(705): Xaa can be any naturally occurring amino acid
  misc_feature (707)..(720): Xaa can be any naturally occurring amino acid
  misc_feature (722)..(1339): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXPPXXXXXXXXXXXXXXXXXXXXIXXXXXXXXXXXXXXXXXXXXXXXXXXXXXXXXXXXXXXXXXXXXXXXXXXXXXXXXXXXXXAXXXXXDXVXXXXXXXXXXXXXXXXXXXXXXGEXLXNDAXXXVXXXXXXXXXXXXXXXXXXXXXXXXXXXXXXXXXFXXXXXXXGXXXGXXXXXXXXXXXXXXXXXXXXXXXXXXXXXXXXXXXXXXXXXYXXAEXXXXXSGXXXXXXXGXXXXXXXXXXXXXXXXXXXXXXXXXXXXXXXXXXXXXXXXFXXXGXXXXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXGXXRGXXXXAXXXXXXXXXXXXXXXXXXXXXXXXXXXXXVXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27417 - protein, 383 aa, artificial
  consensus
  misc_feature (1)..(10): Xaa can be any naturally occurring amino acid
  misc_feature (13)..(34): Xaa can be any naturally occurring amino acid
  misc_feature (37)..(38): Xaa can be any naturally occurring amino acid
  misc_feature (40)..(40): Xaa can be any naturally occurring amino acid
  misc_feature (43)..(165): Xaa can be any naturally occurring amino acid
  misc_feature (167)..(168): Xaa can be any naturally occurring amino acid
  misc_feature (172)..(172): Xaa can be any naturally occurring amino acid
  misc_feature (175)..(184): Xaa can be any naturally occurring amino acid
  misc_feature (187)..(188): Xaa can be any naturally occurring amino acid
  misc_feature (190)..(191): Xaa can be any naturally occurring amino acid
  misc_feature (194)..(203): Xaa can be any naturally occurring amino acid
  misc_feature (205)..(222): Xaa can be any naturally occurring amino acid
  misc_feature (224)..(226): Xaa can be any naturally occurring amino acid
  misc_feature (228)..(229): Xaa can be any naturally occurring amino acid
  misc_feature (232)..(236): Xaa can be any naturally occurring amino acid
  misc_feature (238)..(238): Xaa can be any naturally occurring amino acid
  misc_feature (241)..(244): Xaa can be any naturally occurring amino acid
  misc_feature (246)..(250): Xaa can be any naturally occurring amino acid
  misc_feature (253)..(256): Xaa can be any naturally occurring amino acid
  misc_feature (258)..(279): Xaa can be any naturally occurring amino acid
  misc_feature (281)..(307): Xaa can be any naturally occurring amino acid
  misc_feature (314)..(317): Xaa can be any naturally occurring amino acid
  misc_feature (325)..(325): Xaa can be any naturally occurring amino acid
  misc_feature (328)..(328): Xaa can be any naturally occurring amino acid
  misc_feature (332)..(337): Xaa can be any naturally occurring amino acid
  misc_feature (339)..(352): Xaa can be any naturally occurring amino acid
  misc_feature (354)..(356): Xaa can be any naturally occurring amino acid
  misc_feature (365)..(369): Xaa can be any naturally occurring amino acid
  misc_feature (371)..(372): Xaa can be any naturally occurring amino acid
  misc_feature (374)..(383): Xaa can be any naturally occurring amino acid
XXXXXXXXXXFIXXXXXXXXXXXXXXXXXXXXXXSCXXTXYPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXSLSXYAXXXXXXXXXXLAXXAXXVSXXXXXXXXXXVXXXXXXXXXXXXXXXXXXRXXXAXXDCXXXXXDXVDXXXXSXXXXXELXXXXGXXXXXXXXXXXXXXXXXXXXXXFXXXXXXXXXXXXXXXXXXXXXXXXXXXSNVQTWXXXXSAALTDEXTCXDGFXXXXXXDXXXXXXXXXXXXXXVXXXTSNALALVXXXXXNXXAXXXXXXXXXX

SEQ ID NO: 27418 - protein, 440 aa, artificial
  consensus
  misc_feature (1)..(77): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (95)..(95): Xaa can be any naturally occurring amino acid
  misc_feature (97)..(106): Xaa can be any naturally occurring amino acid
  misc_feature (108)..(108): Xaa can be any naturally occurring amino acid
  misc_feature (111)..(111): Xaa can be any naturally occurring amino acid
  misc_feature (117)..(117): Xaa can be any naturally occurring amino acid
  misc_feature (121)..(121): Xaa can be any naturally occurring amino acid
  misc_feature (128)..(128): Xaa can be any naturally occurring amino acid
  misc_feature (132)..(134): Xaa can be any naturally occurring amino acid
  misc_feature (136)..(137): Xaa can be any naturally occurring amino acid
  misc_feature (139)..(140): Xaa can be any naturally occurring amino acid
  misc_feature (144)..(440): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXYRGVRQRXWGXWVXEIRXPXXXXXXXXXXKXRIXWLGTFXTAEXAARAYDXAARXXXGXXAXXNFPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27419 - protein, 493 aa, artificial
  consensus
  misc_feature (1)..(70): Xaa can be any naturally occurring amino acid
  misc_feature (74)..(75): Xaa can be any naturally occurring amino acid
  misc_feature (78)..(78): Xaa can be any naturally occurring amino acid
  misc_feature (87)..(88): Xaa can be any naturally occurring amino acid
  misc_feature (90)..(143): Xaa can be any naturally occurring amino acid
  misc_feature (145)..(145): Xaa can be any naturally occurring amino acid
  misc_feature (149)..(150): Xaa can be any naturally occurring amino acid
  misc_feature (152)..(227): Xaa can be any naturally occurring amino acid
  misc_feature (232)..(238): Xaa can be any naturally occurring amino acid
  misc_feature (242)..(244): Xaa can be any naturally occurring amino acid
  misc_feature (246)..(249): Xaa can be any naturally occurring amino acid
  misc_feature (254)..(254): Xaa can be any naturally occurring amino acid
  misc_feature (256)..(256): Xaa can be any naturally occurring amino acid
  misc_feature (262)..(283): Xaa can be any naturally occurring amino acid
  misc_feature (292)..(293): Xaa can be any naturally occurring amino acid
  misc_feature (295)..(493): Xaa can be any naturally occurring amino acid
XXXXXXXXXXXXXXXXXXXXXXXXXXXXXXXXXXXXXXXXXXXXXXXXXXXXXXXXXXXXXXXXXXXXXXRATXXVLXAALAVLLLXXSXXXXXXXXXXXXXXXXXXXXXXXXXXXXXXXXXXXXXXXXXXXXXXXXXXXXXXAXAARXXPXXXXXXXXXXXXXXXXXXXXXXXXXXXXXXXXXXXXXXXXXXXXXXXXXXXXXXXXXXXXXXXXXXXXXXXXXXXXAAAAXXXXXXXECEXXXGXXXXDECMXRXRTLAAXXXXXXXXXXXXXXXXXXXXXXHTDYIYTQXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27420 - protein, 457 aa, artificial
  consensus
  misc_feature (1)..(139): Xaa can be any naturally occurring amino acid
  misc_feature (143)..(180): Xaa can be any naturally occurring amino acid
  misc_feature (182)..(196): Xaa can be any naturally occurring amino acid
  misc_feature (200)..(206): Xaa can be any naturally occurring amino acid
  misc_feature (208)..(294): Xaa can be any naturally occurring amino acid
  misc_feature (296)..(297): Xaa can be any naturally occurring amino acid
  misc_feature (302)..(405): Xaa can be any naturally occurring amino acid
  misc_feature (407)..(407): Xaa can be any naturally occurring amino acid
  misc_feature (421)..(421): Xaa can be any naturally occurring amino acid
  misc_feature (424)..(457): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGDEXXXXXXXXXXXXXXXXXXXXXXXXXXXXXXXXXXXXXXEXXXXXXXXXXXXXXXACEXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXQRRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXDAHLDYIYTQHKGXKPXXXXXXXXXXXXXXXXXXXXXXXXXXXXXXXXXX

SEQ ID NO: 27421 - protein, 1509 aa, artificial
  consensus
  misc_feature (1)..(154): Xaa can be any naturally occurring amino acid
  misc_feature (156)..(160): Xaa can be any naturally occurring amino acid
  misc_feature (162)..(175): Xaa can be any naturally occurring amino acid
  misc_feature (177)..(180): Xaa can be any naturally occurring amino acid
  misc_feature (182)..(182): Xaa can be any naturally occurring amino acid
  misc_feature (184)..(192): Xaa can be any naturally occurring amino acid
  misc_feature (194)..(197): Xaa can be any naturally occurring amino acid
  misc_feature (199)..(200): Xaa can be any naturally occurring amino acid
  misc_feature (202)..(204): Xaa can be any naturally occurring amino acid
  misc_feature (207)..(209): Xaa can be any naturally occurring amino acid
  misc_feature (211)..(212): Xaa can be any naturally occurring amino acid
  misc_feature (215)..(225): Xaa can be any naturally occurring amino acid
  misc_feature (231)..(330): Xaa can be any naturally occurring amino acid
  misc_feature (332)..(339): Xaa can be any naturally occurring amino acid
  misc_feature (341)..(342): Xaa can be any naturally occurring amino acid
  misc_feature (344)..(346): Xaa can be any naturally occurring amino acid
  misc_feature (348)..(458): Xaa can be any naturally occurring amino acid
  misc_feature (460)..(531): Xaa can be any naturally occurring amino acid
  misc_feature (533)..(538): Xaa can be any naturally occurring amino acid
  misc_feature (540)..(551): Xaa can be any naturally occurring amino acid
  misc_feature (553)..(907): Xaa can be any naturally occurring amino acid
  misc_feature (909)..(921): Xaa can be any naturally occurring amino acid
  misc_feature (923)..(987): Xaa can be any naturally occurring amino acid
  misc_feature (989)..(991): Xaa can be any naturally occurring amino acid
  misc_feature (993)..(1169): Xaa can be any naturally occurring amino acid
  misc_feature (1171)..(1180): Xaa can be any naturally occurring amino acid
  misc_feature (1182)..(1291): Xaa can be any naturally occurring amino acid
  misc_feature (1293)..(1305): Xaa can be any naturally occurring amino acid
  misc_feature (1307)..(1509): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXAXXXXXXXXXXXXXXPXXXXLXGXXXXXXXXXWXXXXPXXGXXXQPXXXGXXSDXXXXXXXXXXXGRRRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXPXXAXXXDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXFXXXXXXLXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXXTXXXXXXXXXXXXXXXXXXXXXXXXXXXXXXXXXXXXXXXXXXXXXXXXXXXXXXXXXXXXXXXXXGXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27422 - protein, 388 aa, artificial
  consensus
  misc_feature (1)..(1): Xaa can be any naturally occurring amino acid
  misc_feature (4)..(4): Xaa can be any naturally occurring amino acid
  misc_feature (6)..(6): Xaa can be any naturally occurring amino acid
  misc_feature (8)..(11): Xaa can be any naturally occurring amino acid
  misc_feature (13)..(13): Xaa can be any naturally occurring amino acid
  misc_feature (17)..(17): Xaa can be any naturally occurring amino acid
  misc_feature (19)..(22): Xaa can be any naturally occurring amino acid
  misc_feature (24)..(26): Xaa can be any naturally occurring amino acid
  misc_feature (28)..(30): Xaa can be any naturally occurring amino acid
  misc_feature (34)..(56): Xaa can be any naturally occurring amino acid
  misc_feature (58)..(59): Xaa can be any naturally occurring amino acid
  misc_feature (61)..(64): Xaa can be any naturally occurring amino acid
  misc_feature (66)..(66): Xaa can be any naturally occurring amino acid
  misc_feature (68)..(68): Xaa can be any naturally occurring amino acid
  misc_feature (70)..(70): Xaa can be any naturally occurring amino acid
  misc_feature (72)..(73): Xaa can be any naturally occurring amino acid
  misc_feature (76)..(76): Xaa can be any naturally occurring amino acid
  misc_feature (79)..(79): Xaa can be any naturally occurring amino acid
  misc_feature (81)..(81): Xaa can be any naturally occurring amino acid
  misc_feature (87)..(88): Xaa can be any naturally occurring amino acid
  misc_feature (92)..(93): Xaa can be any naturally occurring amino acid
  misc_feature (96)..(96): Xaa can be any naturally occurring amino acid
  misc_feature (98)..(98): Xaa can be any naturally occurring amino acid
  misc_feature (100)..(100): Xaa can be any naturally occurring amino acid
  misc_feature (104)..(105): Xaa can be any naturally occurring amino acid
  misc_feature (107)..(109): Xaa can be any naturally occurring amino acid
  misc_feature (111)..(112): Xaa can be any naturally occurring amino acid
  misc_feature (114)..(117): Xaa can be any naturally occurring amino acid
  misc_feature (120)..(120): Xaa can be any naturally occurring amino acid
  misc_feature (125)..(125): Xaa can be any naturally occurring amino acid
  misc_feature (127)..(129): Xaa can be any naturally occurring amino acid
  misc_feature (131)..(136): Xaa can be any naturally occurring amino acid
  misc_feature (138)..(146): Xaa can be any naturally occurring amino acid
  misc_feature (148)..(159): Xaa can be any naturally occurring amino acid
  misc_feature (162)..(163): Xaa can be any naturally occurring amino acid
  misc_feature (165)..(166): Xaa can be any naturally occurring amino acid
  misc_feature (169)..(169): Xaa can be any naturally occurring amino acid
  misc_feature (172)..(172): Xaa can be any naturally occurring amino acid
  misc_feature (174)..(177): Xaa can be any naturally occurring amino acid
  misc_feature (181)..(181): Xaa can be any naturally occurring amino acid
  misc_feature (184)..(186): Xaa can be any naturally occurring amino acid
  misc_feature (188)..(197): Xaa can be any naturally occurring amino acid
  misc_feature (199)..(200): Xaa can be any naturally occurring amino acid
  misc_feature (202)..(203): Xaa can be any naturally occurring amino acid
  misc_feature (205)..(205): Xaa can be any naturally occurring amino acid
  misc_feature (207)..(223): Xaa can be any naturally occurring amino acid
  misc_feature (226)..(227): Xaa can be any naturally occurring amino acid
  misc_feature (229)..(230): Xaa can be any naturally occurring amino acid
  misc_feature (233)..(236): Xaa can be any naturally occurring amino acid
  misc_feature (239)..(253): Xaa can be any naturally occurring amino acid
  misc_feature (255)..(256): Xaa can be any naturally occurring amino acid
  misc_feature (259)..(263): Xaa can be any naturally occurring amino acid
  misc_feature (265)..(268): Xaa can be any naturally occurring amino acid
  misc_feature (271)..(273): Xaa can be any naturally occurring amino acid
  misc_feature (275)..(279): Xaa can be any naturally occurring amino acid
  misc_feature (282)..(282): Xaa can be any naturally occurring amino acid
  misc_feature (285)..(285): Xaa can be any naturally occurring amino acid
  misc_feature (290)..(290): Xaa can be any naturally occurring amino acid
  misc_feature (293)..(294): Xaa can be any naturally occurring amino acid
  misc_feature (296)..(296): Xaa can be any naturally occurring amino acid
  misc_feature (298)..(299): Xaa can be any naturally occurring amino acid
  misc_feature (301)..(305): Xaa can be any naturally occurring amino acid
  misc_feature (309)..(309): Xaa can be any naturally occurring amino acid
  misc_feature (311)..(311): Xaa can be any naturally occurring amino acid
  misc_feature (313)..(313): Xaa can be any naturally occurring amino acid
  misc_feature (316)..(319): Xaa can be any naturally occurring amino acid
  misc_feature (321)..(321): Xaa can be any naturally occurring amino acid
  misc_feature (323)..(325): Xaa can be any naturally occurring amino acid
  misc_feature (329)..(329): Xaa can be any naturally occurring amino acid
  misc_feature (331)..(331): Xaa can be any naturally occurring amino acid
  misc_feature (337)..(337): Xaa can be any naturally occurring amino acid
  misc_feature (344)..(346): Xaa can be any naturally occurring amino acid
  misc_feature (348)..(388): Xaa can be any naturally occurring amino acid
XGGXRXWXXXXLXTAGXPXXXXPXXXSXXXRRRXXXXXXXXXXXXXXXXXXXXXXXLXXAXXXXGXLXGXDXXLYXYGXAXLPVSTXXLIIXXQLXFXAXFAFXXVXXXFXXTXXXXNAXVLLTXGXXXLXXXXXXDXXXXXXXXXYXXXXXXXXXXXXGFXXTXXAAXLYXFXXXXLPLXELXXXYXXXXXXXXXXTXXLXXEXQXXXXXXXXXXXXXXXXXATXXCXXGMXXXXDFXXXXXXXXXXXXXXXIXXEAXXXXXGXXXXYYXXXVXXXXXWQXFFXGAIGXIFXXSXLXXGXXXXXLLPXTXVXAVXXXXEXFXXXKGVXLXLSLWGXVSYFYGXXXKXXXXXXXXXXXXXXXXXXXXXXXXXXXXXXXXXXXXXXXXX

SEQ ID NO: 27423 - protein, 781 aa, artificial
  consensus
  misc_feature (1)..(2): Xaa can be any naturally occurring amino acid
  misc_feature (4)..(6): Xaa can be any naturally occurring amino acid
  misc_feature (8)..(45): Xaa can be any naturally occurring amino acid
  misc_feature (47)..(159): Xaa can be any naturally occurring amino acid
  misc_feature (162)..(162): Xaa can be any naturally occurring amino acid
  misc_feature (164)..(165): Xaa can be any naturally occurring amino acid
  misc_feature (167)..(226): Xaa can be any naturally occurring amino acid
  misc_feature (228)..(229): Xaa can be any naturally occurring amino acid
  misc_feature (231)..(233): Xaa can be any naturally occurring amino acid
  misc_feature (235)..(239): Xaa can be any naturally occurring amino acid
  misc_feature (241)..(263): Xaa can be any naturally occurring amino acid
  misc_feature (265)..(266): Xaa can be any naturally occurring amino acid
  misc_feature (268)..(273): Xaa can be any naturally occurring amino acid
  misc_feature (276)..(326): Xaa can be any naturally occurring amino acid
  misc_feature (328)..(329): Xaa can be any naturally occurring amino acid
  misc_feature (331)..(369): Xaa can be any naturally occurring amino acid
  misc_feature (371)..(403): Xaa can be any naturally occurring amino acid
  misc_feature (405)..(408): Xaa can be any naturally occurring amino acid
  misc_feature (410)..(419): Xaa can be any naturally occurring amino acid
  misc_feature (422)..(422): Xaa can be any naturally occurring amino acid
  misc_feature (424)..(424): Xaa can be any naturally occurring amino acid
  misc_feature (427)..(427): Xaa can be any naturally occurring amino acid
  misc_feature (429)..(429): Xaa can be any naturally occurring amino acid
  misc_feature (431)..(432): Xaa can be any naturally occurring amino acid
  misc_feature (434)..(435): Xaa can be any naturally occurring amino acid
  misc_feature (437)..(519): Xaa can be any naturally occurring amino acid
  misc_feature (521)..(522): Xaa can be any naturally occurring amino acid
  misc_feature (524)..(524): Xaa can be any naturally occurring amino acid
  misc_feature (526)..(527): Xaa can be any naturally occurring amino acid
  misc_feature (529)..(534): Xaa can be any naturally occurring amino acid
  misc_feature (536)..(541): Xaa can be any naturally occurring amino acid
  misc_feature (543)..(546): Xaa can be any naturally occurring amino acid
  misc_feature (548)..(556): Xaa can be any naturally occurring amino acid
  misc_feature (558)..(583): Xaa can be any naturally occurring amino acid
  misc_feature (586)..(590): Xaa can be any naturally occurring amino acid
  misc_feature (592)..(592): Xaa can be any naturally occurring amino acid
  misc_feature (594)..(602): Xaa can be any naturally occurring amino acid
  misc_feature (604)..(606): Xaa can be any naturally occurring amino acid
  misc_feature (610)..(618): Xaa can be any naturally occurring amino acid
  misc_feature (620)..(620): Xaa can be any naturally occurring amino acid
  misc_feature (624)..(641): Xaa can be any naturally occurring amino acid
  misc_feature (643)..(644): Xaa can be any naturally occurring amino acid
  misc_feature (646)..(647): Xaa can be any naturally occurring amino acid
  misc_feature (650)..(650): Xaa can be any naturally occurring amino acid
  misc_feature (652)..(653): Xaa can be any naturally occurring amino acid
  misc_feature (656)..(781): Xaa can be any naturally occurring amino acid
XXAXXXLXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSXTXXSXXXXXXXXXXXXXXXXXXXXXXXXXXXXXXXXXXXXXXXXXXXXXXXXXXXXXXXXXXXXPXXTXXXAXXXXXEXXXXXXXXXXXXXXXXXXXXXXXKXXGXXXXXXGAXXXXXXXXXXXXXXXXXXXXXXXXXXXXXXXXXXXXXXXXXXXXXXXXXXXLXXGXXXXXXXXXXXXXXXXXXXXXXXXXXXXXXXXXXXXXXXGXXXXXXXXXXXXXXXXXXXXXXXXXXXXXXXXXWXXXXVXXXXXXXXXXLQXPXLKXYXAXXLXXTXXXXXXXXXXXXXXXXXXXXXXXXXXXXXXXXXXXXXXXXXXXXXXXXXXXXXXXXXXXXXXXXXXXXXXXXXXXXXXXXXXXCXXGXIXXLXXXXXXEXXXXXXWXXXXGXXXXXXXXXYXXXXXXXXXXXXXXXXXXXXXXXXXXGPXXXXXYXPXXXXXXXXXAXXXLGEXXXXXXXXXGXIIGXXXXXXXXXXXXXXXXXXIXXGXXLYXVXXGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27424 - protein, 418 aa, artificial
  consensus
  misc_feature (1)..(1): Xaa can be any naturally occurring amino acid
  misc_feature (5)..(5): Xaa can be any naturally occurring amino acid
  misc_feature (9)..(9): Xaa can be any naturally occurring amino acid
  misc_feature (11)..(11): Xaa can be any naturally occurring amino acid
  misc_feature (14)..(15): Xaa can be any naturally occurring amino acid
  misc_feature (17)..(25): Xaa can be any naturally occurring amino acid
  misc_feature (31)..(31): Xaa can be any naturally occurring amino acid
  misc_feature (34)..(36): Xaa can be any naturally occurring amino acid
  misc_feature (42)..(42): Xaa can be any naturally occurring amino acid
  misc_feature (44)..(63): Xaa can be any naturally occurring amino acid
  misc_feature (67)..(86): Xaa can be any naturally occurring amino acid
  misc_feature (88)..(89): Xaa can be any naturally occurring amino acid
  misc_feature (92)..(94): Xaa can be any naturally occurring amino acid
  misc_feature (98)..(98): Xaa can be any naturally occurring amino acid
  misc_feature (103)..(103): Xaa can be any naturally occurring amino acid
  misc_feature (105)..(105): Xaa can be any naturally occurring amino acid
  misc_feature (109)..(109): Xaa can be any naturally occurring amino acid
  misc_feature (112)..(113): Xaa can be any naturally occurring amino acid
  misc_feature (115)..(115): Xaa can be any naturally occurring amino acid
  misc_feature (119)..(119): Xaa can be any naturally occurring amino acid
  misc_feature (121)..(121): Xaa can be any naturally occurring amino acid
  misc_feature (123)..(123): Xaa can be any naturally occurring amino acid
  misc_feature (125)..(126): Xaa can be any naturally occurring amino acid
  misc_feature (128)..(128): Xaa can be any naturally occurring amino acid
  misc_feature (130)..(130): Xaa can be any naturally occurring amino acid
  misc_feature (134)..(134): Xaa can be any naturally occurring amino acid
  misc_feature (137)..(137): Xaa can be any naturally occurring amino acid
  misc_feature (140)..(141): Xaa can be any naturally occurring amino acid
  misc_feature (144)..(144): Xaa can be any naturally occurring amino acid
  misc_feature (148)..(148): Xaa can be any naturally occurring amino acid
  misc_feature (152)..(152): Xaa can be any naturally occurring amino acid
  misc_feature (154)..(180): Xaa can be any naturally occurring amino acid
  misc_feature (182)..(183): Xaa can be any naturally occurring amino acid
  misc_feature (185)..(191): Xaa can be any naturally occurring amino acid
  misc_feature (193)..(194): Xaa can be any naturally occurring amino acid
  misc_feature (199)..(199): Xaa can be any naturally occurring amino acid
  misc_feature (205)..(205): Xaa can be any naturally occurring amino acid
  misc_feature (208)..(208): Xaa can be any naturally occurring amino acid
  misc_feature (212)..(212): Xaa can be any naturally occurring amino acid
  misc_feature (214)..(217): Xaa can be any naturally occurring amino acid
  misc_feature (219)..(219): Xaa can be any naturally occurring amino acid
  misc_feature (221)..(221): Xaa can be any naturally occurring amino acid
  misc_feature (224)..(225): Xaa can be any naturally occurring amino acid
  misc_feature (227)..(230): Xaa can be any naturally occurring amino acid
  misc_feature (232)..(232): Xaa can be any naturally occurring amino acid
  misc_feature (234)..(234): Xaa can be any naturally occurring amino acid
  misc_feature (236)..(237): Xaa can be any naturally occurring amino acid
  misc_feature (239)..(241): Xaa can be any naturally occurring amino acid
  misc_feature (244)..(249): Xaa can be any naturally occurring amino acid
  misc_feature (254)..(254): Xaa can be any naturally occurring amino acid
  misc_feature (258)..(258): Xaa can be any naturally occurring amino acid
  misc_feature (260)..(260): Xaa can be any naturally occurring amino acid
  misc_feature (265)..(266): Xaa can be any naturally occurring amino acid
  misc_feature (269)..(269): Xaa can be any naturally occurring amino acid
  misc_feature (272)..(275): Xaa can be any naturally occurring amino acid
  misc_feature (278)..(278): Xaa can be any naturally occurring amino acid
  misc_feature (280)..(280): Xaa can be any naturally occurring amino acid
  misc_feature (282)..(282): Xaa can be any naturally occurring amino acid
  misc_feature (286)..(291): Xaa can be any naturally occurring amino acid
  misc_feature (293)..(297): Xaa can be any naturally occurring amino acid
  misc_feature (302)..(302): Xaa can be any naturally occurring amino acid
  misc_feature (304)..(305): Xaa can be any naturally occurring amino acid
  misc_feature (307)..(307): Xaa can be any naturally occurring amino acid
  misc_feature (312)..(312): Xaa can be any naturally occurring amino acid
  misc_feature (320)..(320): Xaa can be any naturally occurring amino acid
  misc_feature (327)..(327): Xaa can be any naturally occurring amino acid
  misc_feature (329)..(355): Xaa can be any naturally occurring amino acid
  misc_feature (357)..(375): Xaa can be any naturally occurring amino acid
  misc_feature (377)..(379): Xaa can be any naturally occurring amino acid
  misc_feature (381)..(391): Xaa can be any naturally occurring amino acid
  misc_feature (393)..(418): Xaa can be any naturally occurring amino acid
XALLXPFAXFXEKXXRXXXXXXXXXPPLTFXLLXXXFLLALXGXXXXXXXXXXXXXXXXXXXXQGFXXXXXXXXXXXXXXXXXXXXYXXGLXXXSPTXASAIXNXVPAXTFXXAXVLRXEXVXLXXRXGXAKVXGTXVSXXGAXVITXYKGXPXXXXXXXXXXXXXXXXXXXXXXXXXXXWXXGXXXXXXXCXXWSGWXVLQVPXLKXYPAXLXXXXLXCXFGXXQXXXXAXFXEXXDXXXWKXXXXXXLFTIXYAGXVXSGVAXXLQXWCXXXXGPXFXAXFQPXXXXXXAXXXXXILGDXLXXGXIIGAXLIVIGLYXVLWGKSXEXXXXXXXXXXXXXXXXXXXXXXXXXXXKXXXXXXXXXXXXXXXXXXXRXXXGXXXXXXXXXXXKXXXXXXXXXXXXXXXXXXXXXXXXXX

SEQ ID NO: 27425 - protein, 2606 aa, artificial
  consensus
  misc_feature (1)..(718): Xaa can be any naturally occurring amino acid
  misc_feature (720)..(743): Xaa can be any naturally occurring amino acid
  misc_feature (745)..(753): Xaa can be any naturally occurring amino acid
  misc_feature (756)..(761): Xaa can be any naturally occurring amino acid
  misc_feature (764)..(768): Xaa can be any naturally occurring amino acid
  misc_feature (771)..(790): Xaa can be any naturally occurring amino acid
  misc_feature (792)..(792): Xaa can be any naturally occurring amino acid
  misc_feature (795)..(798): Xaa can be any naturally occurring amino acid
  misc_feature (800)..(813): Xaa can be any naturally occurring amino acid
  misc_feature (815)..(822): Xaa can be any naturally occurring amino acid
  misc_feature (824)..(890): Xaa can be any naturally occurring amino acid
  misc_feature (893)..(895): Xaa can be any naturally occurring amino acid
  misc_feature (899)..(901): Xaa can be any naturally occurring amino acid
  misc_feature (904)..(904): Xaa can be any naturally occurring amino acid
  misc_feature (907)..(907): Xaa can be any naturally occurring amino acid
  misc_feature (909)..(1048): Xaa can be any naturally occurring amino acid
  misc_feature (1052)..(1052): Xaa can be any naturally occurring amino acid
  misc_feature (1055)..(1057): Xaa can be any naturally occurring amino acid
  misc_feature (1060)..(1060): Xaa can be any naturally occurring amino acid
  misc_feature (1062)..(1062): Xaa can be any naturally occurring amino acid
  misc_feature (1064)..(1069): Xaa can be any naturally occurring amino acid
  misc_feature (1071)..(1071): Xaa can be any naturally occurring amino acid
  misc_feature (1073)..(1111): Xaa can be any naturally occurring amino acid
  misc_feature (1113)..(1120): Xaa can be any naturally occurring amino acid
  misc_feature (1123)..(1124): Xaa can be any naturally occurring amino acid
  misc_feature (1126)..(1126): Xaa can be any naturally occurring amino acid
  misc_feature (1129)..(1129): Xaa can be any naturally occurring amino acid
  misc_feature (1131)..(1132): Xaa can be any naturally occurring amino acid
  misc_feature (1135)..(1135): Xaa can be any naturally occurring amino acid
  misc_feature (1137)..(1198): Xaa can be any naturally occurring amino acid
  misc_feature (1200)..(1200): Xaa can be any naturally occurring amino acid
  misc_feature (1202)..(1211): Xaa can be any naturally occurring amino acid
  misc_feature (1213)..(1214): Xaa can be any naturally occurring amino acid
  misc_feature (1217)..(1226): Xaa can be any naturally occurring amino acid
  misc_feature (1228)..(1264): Xaa can be any naturally occurring amino acid
  misc_feature (1266)..(1310): Xaa can be any naturally occurring amino acid
  misc_feature (1316)..(2606): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXVXXXXXXXXXAKXXXXXXLAXXXXXEQXXXXXXXXXXXXXXXXXXXXAXERXXXXYXXXXXXXXXXXXXXMXXXXXXXXMXXXXXXXXXXXXXXXXXXXXXXXXXXXXXXXXXXXXXXXXXXXXXXXXXXXXXXXXXXXXXXXXXXXELXXXEERXXXNLXLSXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYKXNVXXXGAXRXRXXXXXXAXSXXXXXXXXXXXXXXXXXXXXXXXXXXXXXXXXXXXXXXXWXXXXXXXXRIXXSXSIXEXXQKXEXXXXXXXXXXXXXXXXXXXXXXXXXXXXXXXXXXXXXXXXXXXXXXXXXXXXXXXXXXXXXXYXRXXXXXXXXXXEXXELXXXXXXXXXXCXXXXXXXXXXXXXXXXXXXXXXXXXXXXXXXXXXXXXLXXXXXXXXXXXXXXXXXXXXXXXXXXXXXXXXXXXXXXXXXXXXXMKGDYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 27426 - protein, 321 aa, artificial
  consensus
  misc_feature (2)..(3): Xaa can be any naturally occurring amino acid
  misc_feature (17)..(17): Xaa can be any naturally occurring amino acid
  misc_feature (22)..(22): Xaa can be any naturally occurring amino acid
  misc_feature (26)..(27): Xaa can be any naturally occurring amino acid
  misc_feature (34)..(50): Xaa can be any naturally occurring amino acid
  misc_feature (53)..(55): Xaa can be any naturally occurring amino acid
  misc_feature (57)..(57): Xaa can be any naturally occurring amino acid
  misc_feature (60)..(61): Xaa can be any naturally occurring amino acid
  misc_feature (64)..(67): Xaa can be any naturally occurring amino acid
  misc_feature (69)..(70): Xaa can be any naturally occurring amino acid
  misc_feature (72)..(74): Xaa can be any naturally occurring amino acid
  misc_feature (76)..(76): Xaa can be any naturally occurring amino acid
  misc_feature (78)..(101): Xaa can be any naturally occurring amino acid
  misc_feature (108)..(108): Xaa can be any naturally occurring amino acid
  misc_feature (115)..(115): Xaa can be any naturally occurring amino acid
  misc_feature (118)..(118): Xaa can be any naturally occurring amino acid
  misc_feature (121)..(137): Xaa can be any naturally occurring amino acid
  misc_feature (140)..(141): Xaa can be any naturally occurring amino acid
  misc_feature (143)..(145): Xaa can be any naturally occurring amino acid
  misc_feature (147)..(149): Xaa can be any naturally occurring amino acid
  misc_feature (151)..(152): Xaa can be any naturally occurring amino acid
  misc_feature (172)..(172): Xaa can be any naturally occurring amino acid
  misc_feature (174)..(230): Xaa can be any naturally occurring amino acid
  misc_feature (232)..(233): Xaa can be any naturally occurring amino acid
  misc_feature (236)..(236): Xaa can be any naturally occurring amino acid
  misc_feature (240)..(240): Xaa can be any naturally occurring amino acid
  misc_feature (244)..(244): Xaa can be any naturally occurring amino acid
  misc_feature (247)..(247): Xaa can be any naturally occurring amino acid
  misc_feature (251)..(255): Xaa can be any naturally occurring amino acid
  misc_feature (257)..(257): Xaa can be any naturally occurring amino acid
  misc_feature (265)..(265): Xaa can be any naturally occurring amino acid
  misc_feature (280)..(321): Xaa can be any naturally occurring amino acid
LXXEERNLLSVAYKNVXGARRXSWRXXSSIEQKXXXXXXXXXXXXXXXXXYRXXXEXELXXICXXXXLXXLXXXLXPXXXXXXXXXXXXXXXXXXXXXXXXESKVFYXKMKGDYXRYXAEXXXXXXXXXXXXXXXXXAYXXAXXXAXXXLXXTHPIRLGLALNFSVFYYEIXNXXXXXXXXXXXXXXXXXXXXXXXXXXXXXXXXXXXXXXXXXXXXXXXXXXXXXXXXXPXXACXLAKXAFDXAIXELDXXXXXEXSYKDSTLXIMQLLRDNLTLWTSXXXXXXXXXXXXXXXXXXXXXXXXXXXXXXXXXXXXXXXXXX
